US010227608B2

(12) United States Patent
Barry et al.

(10) Patent No.: US 10,227,608 B2
(45) Date of Patent: Mar. 12, 2019

(54) INSECTICIDAL PROTEINS FROM PLANTS AND METHODS FOR THEIR USE

(71) Applicants:PIONEER HI-BRED INTERNATIONAL, INC., Johnston, IA (US); E. I. DU PONT DE NEMOURS AND COMPANY, Wilmington, DE (US)

(72) Inventors: Jennifer Barry, Ames, IA (US); Ryan Michael Gerber, Apex, NC (US); Lu Liu, Palo Alto, CA (US); Amy Lum, Hayward, CA (US); Eric Schepers, Port Deposit, MD (US); Nasser Yalpani, Johnston, IA (US); Genhai Zhu, San Jose, CA (US)

(73) Assignees: PIONEER HI-BRED INTERNATIONAL, INC. IA (US); E I DU PONT DE NEMOURS AND COMPANY, Wilmington, DE (US)

( * ) Notice: Subject to any disclaimer, the term of this patent is extended or adjusted under 35 U.S.C. 154(b) by 64 days.

(21) Appl. No.: 15/116,740

(22) PCT Filed: Feb. 6, 2015

(86) PCT No.: PCT/US2015/014824
§ 371 (c)(1),
(2) Date: Aug. 4, 2016

(87) PCT Pub. No.: WO2015/120276
PCT Pub. Date: Aug. 13, 2015

(65) Prior Publication Data
US 2016/0347799 A1 Dec. 1, 2016

Related U.S. Application Data

(60) Provisional application No. 62/051,720, filed on Sep. 17, 2014, provisional application No. 61/937,295, filed on Feb. 7, 2014.

(51) Int. Cl.
| | | |
|---|---|---|
| *C12N 15/82* | (2006.01) | |
| *A01H 5/10* | (2018.01) | |
| *C07K 14/415* | (2006.01) | |
| *A01N 37/46* | (2006.01) | |
| *A01N 63/02* | (2006.01) | |
| *A01N 37/18* | (2006.01) | |

(52) U.S. Cl.
CPC ......... *C12N 15/8286* (2013.01); *A01N 37/18* (2013.01); *A01N 37/46* (2013.01); *A01N 63/02* (2013.01); *C07K 14/415* (2013.01); *Y02A 40/162* (2018.01)

(58) Field of Classification Search
CPC .................. C12N 15/8286; C07K 14/415
See application file for complete search history.

(56) References Cited

U.S. PATENT DOCUMENTS

| 2012/0233726 A1 | 9/2012 | Abad et al. |
| 2017/0166921 A1* | 6/2017 | Barry ................. C12N 15/8286 |

FOREIGN PATENT DOCUMENTS

| WO | 2013/098858 A2 | 7/2013 |
| WO | 2015/120270 A1 | 8/2015 |

OTHER PUBLICATIONS

NCBI Accession WP_009624750 (Year: 2013).*
Guo et al (PNAS 2004 (101)25, 9205-9210) (Year: 2004).*
International Search Report and Written Opinion for International Application No. PCT/US2015/014824 Completed May 13, 2015.
Database Accession JQ438776, "Tectaria macrodonta chitin binding protein mRNA, complete cds", Feb. 14, 2014 (Feb. 14, 2014).
Markham, Kevin, et al.: "Evaluation of Fern and Moss Protein-Based Defenses Against Phytophagous Insects", International Journal of Plant Sciences, 2006, vol. 167, No. 1, pp. 111-117.

* cited by examiner

*Primary Examiner* — Lee A Visone

(57) ABSTRACT

Compositions and methods for controlling pests are provided. The methods involve transforming organisms with a nucleic acid sequence encoding an insecticidal protein. In particular, the nucleic acid sequences are useful for preparing plants and microorganisms that possess insecticidal activity. Thus, transformed bacteria, plants, plant cells, plant tissues and seeds are provided. Compositions are insecticidal nucleic acids and proteins of bacterial species. The sequences find use in the construction of expression vectors for subsequent transformation into organisms of interest including plants, as probes for the isolation of other homologous (or partially homologous) genes. The pesticidal proteins find use in controlling, inhibiting growth or killing Lepidopteran, Coleopteran, Dipteran, fungal, Hemipteran and nematode pest populations and for producing compositions with insecticidal activity.

23 Claims, 21 Drawing Sheets
Specification includes a Sequence Listing.

Fig. 2a

```
                      [- MOTIF 19 -]   [------------MOTIF 7 --
                      *        20          *        40        *
PtIP-83Aa      : -------MALVDYGKLFEDLNQISMGVLDRVEFSEVMVIHRMYVRLADLN : 43
PtIP-83Ca      : ----------MDYSTLYRDLNQISIG-VDRVEFSEVMVIHRMYVRLSDLN : 39
PtIP-83Cb      : ----------MDYSTLYRDLNQISMP-LDRVEFSEVMVIHRMYLRLSDLN : 39
PtIP-83Cc      : ----------MDYSTLYRDLNQISIG-VDRVEFSEVMVIHRMYVRLSDLN : 39
PtIP-83Cd      : ----------MDYSTLYRDLNQISIG-VDRVEFSEVMVIHRMYVRLSDLN : 39
PtIP-83Ce      : ----------MDYSTLYRDLNQISIG-VDRVEFSEVMVIHRMYVRLSDLN : 39
PtIP-83Cf      : ------MASVLDYSTLYRDLNQISMA-VDQVEFSEVMVIHRMYVNLADLD : 43
PtIP-83Fa      : ----------MEYSSLYGDVNQVSLR-FQNMEFSEVMVVHRMHVRLEELD : 39
gi-598378568   : MGNSIAAAEARNYEEIYKDANHIGAKSLITPVCSEVMTVCRMYVRLDDLD : 50
PtIP-83Aa_SSE  : -------CCCCCCCHHHHHHHHHCCCCCCCCCHHHHHHHHHHHHCCCC : 43
PtIP-83Ca_SSE  : ----------CCHHHHHHCCCCCCC-CCCEEECCEEEEEEHHEECCCCC : 39
PtIP-83Cb_SSE  : ----------CCHHHHHHCCCCCCC-CCCCCHHHHHHHHHHHCCCCC : 39
PtIP-83Cc_SSE  : ----------CCHHHHHHCCCCCCC-CCCEEECCEEEEEEHHEECCCCC : 39
PtIP-83Cd_SSE  : ----------CCHHHHHHCCCCCCC-CCCEEECCEEEEEEHHEECCCCC : 39
PtIP-83Ce_SSE  : ----------CCHHHHHHCCCCCCC-CCCEEEHHEEEEEEHHEECCCCC : 39
PtIP-83Cf_SSE  : ------CCCCCCHHHHHHHHHHHHH-CCCEEEEEEEEEEEEECCCCCCH : 43
PtIP-83Fa_SSE  : ----------CCCCCCCCCCCCEEEE-ECCCCCEEEEEEECCCCCCCCC : 39
gi-598378568   : CCCHHHHHHHHCCHHHHHHCCCCCCCCCCCCCCCCEEEEEECCCCCHHHH : 50

------------------]    [-------- MOTIF 13 ---
                         60        *        80        *        100
PtIP-83Aa      : VGQLEGAEKVKRLYVFADVVELPVVEWRWPP--QIPGSVTVIILCRLLQW : 91
PtIP-83Ca      : VGELPGAGRVKRVYVFADVVELAPRATLRDQ-MHMPGSVTVIVLCRLLQF : 88
PtIP-83Cb      : VGELPGAERVKRLYVLADVVELATFAHPQLLNTRMPGSVTVIILCRLLQF : 89
PtIP-83Cc      : VGELPGAGRVKRVYVFADVVELAPRATLRDQ-MHMPGSVTVIVLCRLLQF : 88
PtIP-83Cd      : VGELPGAGRVKRVYVFADVVELAPRETLRDQ-MHMPGSVTVIILCRLLQF : 88
PtIP-83Ce      : VGELPGAGRVKRVYVFADVVELAPRATLRDQ-MHMPGSVTVIVLCRLLQF : 88
PtIP-83Cf      : VAELVGAETVKRVYVFADVVELAPGKR-----TQLPGSVTVIILCRLLQF : 88
PtIP-83Fa      : MTGVEGIEKVKRLYVLADVVELPSTATQVFQYLRLPASISAIILCRVLYI : 89
gi-598378568   : VKVLERAEEVKVLYVVADVVEVRGDAV------QLPPSVQLILSCRVLFF : 94
PtIP-83Aa_SSE  : CCCCCHHHHHEEEEEECCCCCEEECCCC--CCCCCEEEEEEHHCCCC : 91
PtIP-83Ca_SSE  : CCCCCCCCCEEEEEEEECCCCCCCCCCC-CCCCCEEEEEECCEEE : 88
PtIP-83Cb_SSE  : CCCCCCHHHHHHHHHHHHHHHCCCCCCCCCCCCCEEEEEEHHCCC : 89
PtIP-83Cc_SSE  : CCCCCCCCCEEEEEEEHHCCCCCCCCCC-CCCCCEEEEEECCEEE : 88
PtIP-83Cd_SSE  : CCCCCCCCCEEEEEEECCCCCCCHHHH-CCCCCCEEEEEECCEE : 88
PtIP-83Ce_SSE  : CCCCCCCCCEEEEEEHHCCCCCCCCCC-CCCCCEEEEEECCEEE : 88
PtIP-83Cf_SSE  : HHHHCCCCCEEEEEEEECCCCCCC-----CCCCCEEEEEEECCCC : 88
PtIP-83Fa_SSE  : CCCCHHHHHHHHEEECCCCCCHHHHHHHHCCCCCHHHHHHHHCC : 89
gi-598378568   : HHHHHCCCCCEEEEEEEEEECCCCC------CCCCCEEEEEEEEE : 94
```

Fig. 2b

```
                    ----------] [---- MOTIF 20 -----]
                           *         120         *         140         *
PtIP-83Aa      : PTDGRQS---DTELHLTFMKL AI-QREE-NRWEITAADG----MNWGVY : 132
PtIP-83Ca      : PIDGSQ----ATTLRLPFMQL AR-VIEQNVKSEITATDG----MNWGIY : 129
PtIP-83Cb      : PTDGSF----AAWLELPFMEL T--LIEQ-YRSEIKAADD----AKWGTY : 128
PtIP-83Cc      : PIDGSQ----ATTLRLPFMQL AR-VIEQNVKSEITATDG----MNWGIY : 129
PtIP-83Cd      : PIDGSQ----ATTLRLPFMQL AR-VIEQNVKSEITATDG----MNWGIY : 129
PtIP-83Ce      : PIDGSQ----ATTLRLPFMQL AR-VIEQNVKSEITATDG----MNWGIY : 129
PtIP-83Cf      : PTGGSR----AATLQLPFMKV AT-LIER-FRSEIAAADG----MNWGTY : 128
PtIP-83Fa      : PEVDQRPHMAQCSLDFPFMRL VVGSVHENVGGVMQAFSSDATPSNIGIY : 139
gi-598378568   : SSGNGWP--QVALLQGPLVQYNGN---------YSPVTG-----NWSAT : 127
PtIP-83Aa_SSE  : CCCCCCC---CCHHHHHHHH HH-HCCC-CCEEEECCC----CCEEEE : 132
PtIP-83Ca_SSE  : CCCCCC----CCCCCCCHHHH HH-HHHHCCCCEEECCC----CCEEEE : 129
PtIP-83Cb_SSE  : CCCCCC----HHHHCCCHHHH H--HHHH-HHHHHHHHHC----CCCEEE : 128
PtIP-83Cc_SSE  : CCCCCC----CCCCCCCHHHH HH-HHHHCCCCEEECCC----CCEEEE : 129
PtIP-83Cd_SSE  : CCCCCC----CCCCCCCHHHH HH-HHHHCCCCEEECCC----CCEEEE : 129
PtIP-83Ce_SSE  : CCCCCC----CCCCCCCHHHH HH-HHHHCCCCEEECCC----CCEEEE : 129
PtIP-83Cf_SSE  : CCCCCC----CEEECCCCCEEEEE-HHHH-HHHHHHHCC----CCEECE : 128
PtIP-83Fa_SSE  : CCCCCCCCCCCCCCCCCCEEEECCCCCCCCHHHHCCCCCCCCCEEEE : 139
gi-598378568   : ECCCCCC--EEECCCCCEECCC---------CCCCCC-----CCCCC : 127

160         *         180         *         200
PtIP-83Aa      : IHA EVQVGVLTMSWSSVLRVSALRSVITSGFRA-------------VSV : 169
PtIP-83Ca      : IYG KVERSPLLPSNA-ILAVWADRCTITSAR---------------HNH : 163
PtIP-83Cb      : VHA EVQLSPLFNGWP-YLVVEAQRCIITAAM---------------HNT : 162
PtIP-83Cc      : IYG KVERSPLLPSNA-ILAVWADRCTITSAR---------------HNH : 163
PtIP-83Cd      : IYG KVERSPLLPSNA-ILAVWADRCTITSAR---------------HNH : 163
PtIP-83Ce      : IYG KVERSPLLPSNA-ILAVWADRCTITSAR---------------HNH : 163
PtIP-83Cf      : IHG EVQVSPLYPNNS-ILGVWADRSIITSAF---------------HNV : 162
PtIP-83Fa      : LHADRFIYRQATSPASNFVLPLDVRVSFGSSTYSGPTIRPDWQNLNVSNI : 189
gi-598378568   : PLL QDTYR---------FFLHGQQLLILSGT----------------- : 150
PtIP-83Aa_SSE  : EEE EEEEEEEEEEECCCHHHHHHHHHHHHCCCEE-------------EEE : 169
PtIP-83Ca_SSE  : EEE ECCCCCCCCCCE-EEEEECCCCCCCCCC---------------CCC : 163
PtIP-83Cb_SSE  : EEE EEEECCCCCCCC-CCEEEECEEEEEEEC---------------CCC : 162
PtIP-83Cc_SSE  : EEE ECCCCCCCCCCE-EEEEECCCCCCCCCC---------------CCC : 163
PtIP-83Cd_SSE  : EEE ECCCCCCCCCCE-EEEEECCCCCCCCCC---------------CCC : 163
PtIP-83Ce_SSE  : EEE ECCCCCCCCCCE-EEEEECCCCCCCCCC---------------CCC : 163
PtIP-83Cf_SSE  : ECCCEEECCCCCCCC-CCCCCCCCCCCCCCC---------------CCC : 162
PtIP-83Fa_SSE  : ECCCHHHCCCCCCCCCEEEEEEEECCCCCCCCCCCCCCCCCCCCCCCC : 189
gi-598378568   : CCCCCCCCE---------EEECCCCCEEECCC----------------- : 150
```

Fig. 2c

```
                              *         220           *          240          *
PtIP-83Aa       : FEVPGSVRSTLGATLRPDHALYSTTMQATPNASHISAFNLRIVSPSAYR-       : 218
PtIP-83Ca       : VNAPGRIISTFTLGSG-VTG--ITSMHGEPSLDPWNGVSLDSASPTAFS-       : 209
PtIP-83Cb       : FNRPGWVRSITQFTTD-QSGRVDTTLLARTEFGHID-LPLETDSPTAFS-       : 209
PtIP-83Cc       : VNAPGRIISTFTLGSG-VTG--ITSMHGEPSLDPWNGVSLDSASPTAFS-       : 209
PtIP-83Cd       : VNAPGRIISTFTLGSG-VTG--ITSMHGEPSLDPWNGVSLDSASPTAFS-       : 209
PtIP-83Ce       : VNAPGRIISTFTLGSG-VTG--ITSMHGEPSLDPWNGVSLDSASPTAFS-       : 209
PtIP-83Cf       : FDEPGRVISSTSITRA-QSAPNNTTMSAEPGWLSGNRFLLYTVSRSAFS-       : 210
PtIP-83Fa       : SYGPQHLSKGPPLTSSDSDLQRSDEIELLAQQDVWSPLLHVAFSPTALPG       : 239
gi-598378568    : ---SGRASGDNILSED-----------------EKKLQLQSSTAPILP-       : 178
PtIP-83Aa_SSE   : EEECCCCCCCCCCCCCCCCCCCCCCCCCCCCCCCCEEEEECCCEEE-          : 218
PtIP-83Ca_SSE   : CCCCCCEEEEEEECCC-CCC--CCEEECCCCCCCCCCCCCCCCCCCCCC-       : 209
PtIP-83Cb_SSE   : CCCCCCEEEECCCEEEEC-CCCCCCCCCCCCCCCCCCC-CCCCCCCCEEE       : 209
PtIP-83Cc_SSE   : CCCCCCEEEEEEECCC-CCC--CCEEECCCCCCCCCCCCCCCCCCCCCC-       : 209
PtIP-83Cd_SSE   : CCCCCCEEEEEEECCC-CCC--CCEEECCCCCCCCCCCCCCCCCCCCCC-       : 209
PtIP-83Ce_SSE   : CCCCCCEEEEEEECCC-CCC--CCEEECCCCCCCCCCCCCCCCCCCCCC-       : 209
PtIP-83Cf_SSE   : CCCCEEEECCCCCCC-CCCCCCCCCCCCCCCCCCCEEEEEEECCEEE-         : 210
PtIP-83Fa_SSE   : CCCCCCCCCCCCCCCCCCCCCCCCHHHHHHHHCCCCCCHHCCCCCCCCCC       : 239
gi-598378568    : ---CCCCCCCEECCCC-----------------HHHHHCCCCCCCCCC-        : 178

[------ MOTIF 14 -------]
                         260          *          280          *          300
PtIP-83Aa       : VCPLQN---DTDTYLGIPADVAAVLPVDVVTDPNILLGMQTTVHIAELVK       : 265
PtIP-83Ca       : ALPRQ----SRN--ISFTS-----IPVEVVTDPSILLGMQTTVLIAELVK       : 248
PtIP-83Cb       : VSHRQ----STNLPVEYTG-----IPVEVVTDPNILMGMQTSVHIAELVK       : 250
PtIP-83Cc       : ALPRQ----SRN--ISFTS-----IPVEVVTDPSILLGMQTTVLIAELVK       : 248
PtIP-83Cd       : ALPRQ----SRN--ISFTS-----IPVEVVTDPSILLGMQTTVLIAELVK       : 248
PtIP-83Ce       : ALPRQ----SRN--ISFTS-----IPVEVVTDPSILLGMQTTVLIAELVK       : 248
PtIP-83Cf       : VLPSQ----STN--VSFTS-----IPVEVVTDPNILLGMQTTVHIAELVK       : 249
PtIP-83Fa       : NIPGTQGLFRPSSACSFFHVPPPDVPANVLTDPSIILGMQMNMLIAELVL       : 289
gi-598378568    : ------------------------PRWVMEDPHILSGLEASVITSELIV       : 203
PtIP-83Aa_SSE   : ECCCCC---CCCCCCCCCCCCCCCCCCCCHHHHHHHHHHHHHHHHHH          : 265
PtIP-83Ca_SSE   : CCCCC----CCC--CCCCC-----CCEEEECCCCCCCCCHHHHHHHHHH        : 248
PtIP-83Cb_SSE   : EECCC----CCCCCCCCCC-----CCEEEECCCHHCCCHHHHHHHHHH         : 250
PtIP-83Cc_SSE   : CCCCC----CCC--CCCCC-----CCEEEECCCCCCCCCHHHHHHHHHH        : 248
PtIP-83Cd_SSE   : CCCCC----CCC--CCCCC-----CCEEEECCCCCCCCCHHHHHHHHHH        : 248
PtIP-83Ce_SSE   : CCCCC----CCC--CCCCC-----CCEEECCCCCCCCCCHHHHHHHHHH        : 248
PtIP-83Cf_SSE   : EECC----CEE--EEEC-----CCCCCCCCHHHHHHHHHHHHHHHH           : 249
PtIP-83Fa_SSE   : CCCCCCCCCCCCCCCCCCCCCCCCCCCCCCCCHHHHHHHHHHHHHHHH         : 289
gi-598378568    : ------------------------CCCCCCCCCCCCHHHHHHHHHH          : 203
                                                                helix-1
```

Fig. 2d

```
                                 *         320          *        340           *
PtIP-83Aa       : ACHP-SPDVVSAVGE LNWLNKLLLPLKES-TQLQGSESYKECLALLGRV : 313
PtIP-83Ca       : VCRPPSPDMMSAVAE ALWLNDVLLQVVQNESQLQGTAPYNECLALLGRI : 298
PtIP-83Cb       : ACYP-SPELVSAVGV VNWLNEVLLRVVQKESQLQGTEAYNECLALLGRI : 299
PtIP-83Cc       : VCRPPSPDMMSAVAE ALWLNDVLLQVVQKESQMQGTAPYNECLALLGRI : 298
PtIP-83Cd       : VCRPPSPDMMSAVAE ALWLNDVLLQVVQKESQMQGTAPYNECLALLGRI : 298
PtIP-83Ce       : VCRPPSPDMMSAVAE ALWLNDVLLQVVQKESQMQGTAPYNECLALLGRI : 298
PtIP-83Cf       : AGHP-SPDIVSAVAE AIWLSKVLLQVVQNESHLQGTESYNECLALLGRV : 298
PtIP-83Fa       : AAHN-SPQVMNVITK VLWLNKILLQVASP---------NDDILALLFRI : 329
gi-598378568    : GHMTHAVDLVAEVKL VEWLLLLLRHVLNET--MTNAEANHLLRSLFFRV : 251
PtIP-83Aa_SSE   : HCCC-CHHHHHHHH HHHHHHHHCCCCCC-HHHCCCCHHHHHHHHHHHH : 313
PtIP-83Ca_SSE   : CCCCCCHHHHHHHH HHHHHHHHHHHHHHCCCCCCCCHHHHHHHHHHH : 298
PtIP-83Cb_SSE   : HHCC-CCHHHHHHHH HHHHHHHHHHHHCCCCCCCCHHHHHHHHHHHHH : 299
PtIP-83Cc_SSE   : CCCCCCHHHHHHHH HHHHHHHHHHHHHHHHCCCCCHHHHHHHHHHHH : 298
PtIP-83Cd_SSE   : CCCCCCHHHHHHHH HHHHHHHHHHHHHHHHHHCCCCCHHHHHHHHHHH : 298
PtIP-83Ce_SSE   : CCCCCCHHHHHHHH HHHHHHHHHHHHHHHHHHCCCCCHHHHHHHHHHH : 298
PtIP-83Cf_SSE   : HCCC-CHHHHHHHH HHHHHHHHHHHHCCCCCCCCHHHHHHHHHHHHH : 298
PtIP-83Fa_SSE   : HHCC-CCCCHHHHHH HHHHHHHHHHCCC---------CHHHHHHHHHH : 329
gi-598378568    : HCCCCCHHHHHHHH HHHHHHHHHHHHHH--HHHHHHHHHHHHHHHHH : 251
                           helix-2                     helix-3

---- MOTIF 22 -] [--------------- MOTIF 2 ---------
                          360          *        380          *        400
PtIP-83Aa       : HAAMKMVR----IGLVVPQLQYRMYGSLINQMAQVAQNYDREFKQFKLFI : 359
PtIP-83Ca       : ECVMKIGR----FVSVVPQLQYRMYGNLIKQMAQVAQNYDQEFKQFKLFI : 344
PtIP-83Cb       : QCVMKMGP----FVSVVPQLQYRMYGSLIRQMAQVAQNYDQDFRQLKLFI : 345
PtIP-83Cc       : ECVMKIGR----FVSVVPQLQYRMYGNLIKQMAQVAQNYDQEFKQFKLFI : 344
PtIP-83Cd       : ECVMKIGR----FVSVVPQLQYRMYGNLIKQMAQVAQNYDQEFKQFKLFI : 344
PtIP-83Ce       : ECVMKIGR----FVSVVPQLQYRMYGNLIKQMAQVAQNYDQEFKQFKLFI : 344
PtIP-83Cf       : QSVIKMGR----FGLVVPQLQYRMYGSLIKQMAQVAQNYDQDFKRFRLFI : 344
PtIP-83Fa       : QAFMKMAKQ---PRFVVPRLQYHMYGSLINRMVQVAQNYDQEFKQLKLFI : 376
gi-598378568    : QSLVRMATAAQNNILVVPRLQHHAYSEYINRLAELARTYDSDFKALTLFI : 301
PtIP-83Aa_SSE   : HHHHCCCC----CCCEEECCCHHHHHHHHHHHHHHHHHHHHHHHHHHHHH : 359
PtIP-83Ca_SSE   : HHHHHHCC----CCCCCCCCHHHHHHHHHHHHHHHHHHHHHHHHHHHHHH : 344
PtIP-83Cb_SSE   : HHHHCCCC----CCCCCCCCHHHHHHHHHHHHHHHHHHHHHHHHHHHHHH : 345
PtIP-83Cc_SSE   : HHHHHCCC----CCCCCCCCHHHHHHHHHHHHHHHHHHHHHHHHHHHHHH : 344
PtIP-83Cd_SSE   : HHHHHCCC----CCCCCCCCHHHHHHHHHHHHHHHHHHHHHHHHHHHHHH : 344
PtIP-83Ce_SSE   : HHHHHCCC----CCCCCCCCHHHHHHHHHHHHHHHHHHHHHHHHHHHHHH : 344
PtIP-83Cf_SSE   : HHHHHHCC----CCCCCCCCHHHHHHHHHHHHHHHHHHHHHHHHHHHHHH : 344
PtIP-83Fa_SSE   : HHHHHHCCC---CCCEECCCCHHHHHHHHHHHHHHHHHHHHHHHHHHHHH : 376
gi-598378568    : HHHHHHHHCCCCCCCCCCCCCHHHHHHHHHHHHHHHHHHHHHHHHHHHHH : 301
```

Fig. 2e

```
                     ---------------][---------------- MOTIF 8 -------
                          *          420          *         440         *
PtIP-83Aa        : IQNQILGSYLLQQNRAFAERELQMESF AAVISQRREELDNTFAKMDRLS : 409
PtIP-83Ca        : VQNQILGSYLLQKNKALADRELQMESF SAVISQRRQELNTAIAKMERMS : 394
PtIP-83Cb        : AQNQILGSYLLQQNKAFADREVQMESF SAVISQRRQELDDAIAKMDRLS : 395
PtIP-83Cc        : IQNQIFGSYLLQQNKAFADRELQMESF SAVISQRRQELNTAIAKMERMS : 394
PtIP-83Cd        : IQNQIFGSYLLQQNKAFADRELQMESF SAVISQRRQELNTAIAKMERMS : 394
PtIP-83Ce        : IQNQIFGSYLLQQNKAFADRELQMESF SAVISQRRQELNTAIAKMERMS : 394
PtIP-83Cf        : LQNQILGSYLLEQNKAFADRELQMESF SAVISQRKGELDTAFAKMDRLS : 394
PtIP-83Fa        : AQNEILGSYLLQQNRAFEREKEMSAF  SQVVSMRRSELQSAIQTMDNLS : 426
gi-598378568     : QQNEILGSYLLEQNKAFAEKERDMEVVYTTLNDIKMSELIQALGQLERLG : 351
PtIP-83Aa_SSE    : HHHHHHHHHHHHHHHHHHHHHHHHHHH HHHHHHHHHHHHHHHHHHHHHH : 409
PtIP-83Ca_SSE    : HHHHHHHHHHHHHHHHHHHHHHHHHHH HHHHHHHHHHHHHHHHHHHHHH : 394
PtIP-83Cb_SSE    : HHHHHHHHHHHHHHHHHHHHHHHHHHH HHHHHHHHHHHHHHHHHHHHHH : 395
PtIP-83Cc_SSE    : HHHHHHHHHHHHHHHHHHHHHHHHHHH HHHHHHHHHHHHHHHHHHHHHH : 394
PtIP-83Cd_SSE    : HHHHHHHHHHHHHHHHHHHHHHHHHHH HHHHHHHHHHHHHHHHHHHHHH : 394
PtIP-83Ce_SSE    : HHHHHHHHHHHHHHHHHHHHHHHHHHH HHHHHHHHHHHHHHHHHHHHHH : 394
PtIP-83Cf_SSE    : HHHHHHHHHHHHHHHHHHHHHHHHHHH HHHHHHHHHHHHHHHHHHHHHH : 394
PtIP-83Fa_SSE    : HHHHHHHHHHHHHHHHHHHHHHHHHHH HHHHHHHHHHHHHHHHHHHHHH : 426
gi-598378568     : HHHHHHHHHHHHHHHHHHHHHHHHHHH HHHHHHHHHHHHHHHHHHHHHH : 351
                                             helix-4

----------------] [------- MOTIF 15 -------] [---
                           *         460         *         480         *         500
PtIP-83Aa        : GQMEAESSAMEQAKKEMDEGLRQFQNRQVANALFAVLSAVAQIGLAFLTA : 459
PtIP-83Ca        : LQMEEENRAMEQAQKEMEEGLREFQNRQVARAVFAVLKAVAMIALVFVTA : 444
PtIP-83Cb        : LQMEEEDRAMEQARKEMEEGLKQFQNEQVARAVFAVLKSVAMIALAFVTA : 445
PtIP-83Cc        : LQMEEENRAMEQAQKEMEEGLREFQNRQVARAVFAVLKAVAMIALAFVTA : 444
PtIP-83Cd        : LQMEEENRAMEQAQKEMEEGLREFQNRQVARAVFAVLKAVAMIALAFVTA : 444
PtIP-83Ce        : LQMEEENRAMEQAQKEMEEGLREFQNRQVARAVFAVLKAVAMIALAFVTA : 444
PtIP-83Cf        : LQMEEENGAMEQAQKEMDEGLRQFQNRQVARALFAVLRAVAQIGLAFVTA : 444
PtIP-83Fa        : LQMESESEAMNEAQENMVEAIQEYERKLLARALFSVIGAIASVALAFATG : 476
gi-598378568     : EEMGKMSEEMEQAREDMEKGLKIYRNKQVARAAFSLLNAIAQIGLAIFTA : 401
PtIP-83Aa_SSE    : HHHHHHHHHHHHHHHHHHHHHHHHHHHHHHHHHHHHHHHHHHHHHHHHH  : 459
PtIP-83Ca_SSE    : HHHHHHHHHHHHHHHHHHHHHHHHHHHHHHHHHHHHHHHHHHHHHHHHH  : 444
PtIP-83Cb_SSE    : HHHHHHHHHHHHHHHHHHHHHHHHHHHHHHHHHHHHHHHHHHHHHHHHH  : 445
PtIP-83Cc_SSE    : HHHHHHHHHHHHHHHHHHHHHHHHHHHHHHHHHHHHHHHHHHHHHHHHH  : 444
PtIP-83Cd_SSE    : HHHHHHHHHHHHHHHHHHHHHHHHHHHHHHHHHHHHHHHHHHHHHHHHH  : 444
PtIP-83Ce_SSE    : HHHHHHHHHHHHHHHHHHHHHHHHHHHHHHHHHHHHHHHHHHHHHHHHH  : 444
PtIP-83Cf_SSE    : HHHHHHHHHHHHHHHHHHHHHHHHHHHHHHHHHHHHHHHHHHHHHHHHH  : 444
PtIP-83Fa_SSE    : HHHHHHHHHHHHHHHHHHHHHHHHHHHHHHHHHHHHHHHHHHHHHHHHC  : 476
gi-598378568     : HHHHHHHHHHHHHHHHHHHHHHHHHHHHHHHHHHHHHHHHHHHHHHHHH  : 401
```

Fig. 2f

```
                              [------------------- MOTIF 9 -------------------]
                                      *         520         *         540         *
PtIP-83Aa       : GAT---APGAVASAGQAVSIAGQAAQGLRRVVEILEQLEAVMEVVAAVKD : 506
PtIP-83Ca       : GAT---APGAAASAGQAVSIAGQAAQALRRVVEILEGLEAVMEVVAAVKD : 491
PtIP-83Cb       : GAT---APGAAASAAQAVNIAGQAAQALRRVVEILEGLEAVMEVVAAIKH : 492
PtIP-83Cc       : GAT---APGAAASAGQAVSIAGQAAQALRRVVEILEGLEAVMEVVAAVKD : 491
PtIP-83Cd       : GAT---APGAAASAGQAVSIAGQAAQALRRVVEILEGLEAVMEVVAAVKD : 491
PtIP-83Ce       : GAT---APGAAASAGQAVSIAGQAAQALRRVVEILEGLEAVMEVVAAVKD : 491
PtIP-83Cf       : GAT---APGAVASAGQAVSIAGQAAQGLRRVVEILEQLEAVMEVVAAVKD : 491
PtIP-83Fa       : GAT---APGAVAAAGGAVAAAGRLAAGLQKVVDILQGLQAVMEVVVAIRD : 523
gi-598378568    : GATTGLAASAVANAGQAITQATEAVQQLRRIFETIEKILLLAEVLVAMRD : 451
PtIP-83Aa_SSE   : CCC---CHHHHHHHHHHHHHHHHHHHHHHHHHHHHHHHHHHHHHHHHHHH : 506
PtIP-83Ca_SSE   : CCC---CCHHHHHHHHHHHHHHHHHHHHHHHHHHHHHHHHHHHHHHHHHH : 491
PtIP-83Cb_SSE   : HCC---CHHHHHHHHHHHHHHHHHHHHHHHHHHHHHHHHHHHHHHHHHHH : 492
PtIP-83Cc_SSE   : CCC---CCHHHHHHHHHHHHHHHHHHHHHHHHHHHHHHHHHHHHHHHHHH : 491
PtIP-83Cd_SSE   : CCC---CCHHHHHHHHHHHHHHHHHHHHHHHHHHHHHHHHHHHHHHHHHH : 491
PtIP-83Ce_SSE   : CCC---CCHHHHHHHHHHHHHHHHHHHHHHHHHHHHHHHHHHHHHHHHHH : 491
PtIP-83Cf_SSE   : CCC---CHHHHHHHHHHHHHHHHHHHHHHHHHHHHHHHHHHHHHHHHHHH : 491
PtIP-83Fa_SSE   : CCC---CHHHHHHHHHHHHHHHHHHHHHHHHHHHHHHHHHHHHHHHHHHH : 523
gi-598378568    : CCCCHHHHHHHHHHHHHHHHHHHHHHHHHHHHHHHHHHHHHHHHHHHHHH : 451
                                                         helix-5

[- MOTIF 21 -][---------------- MOTIF 1 --------
                          *         580         *         600
PtIP-83Aa       : LVDSLEQVGQIVDAPVMPELPSEADWSIFVNEVEAVAEGMPTEVSEVPVW : 556
PtIP-83Ca       : LVDSLEQVGQIVGAPEMPDMPSEADWSIFVNEIEAVAEGMPTEVSEVPAW : 541
PtIP-83Cb       : LVDALDQVSQIVDAPPMPDMPSEADWSIFVNEIEAVAEGMPTEVSEVPAW : 542
PtIP-83Cc       : LVDSLEQVGHIVGAPEMPDMPSEADWSIFVNEIEAVAEGMPTEVSEVPAW : 541
PtIP-83Cd       : LVDSLEQVGHIVGAPEMPDMPSEADWSIFVNEIEAVAEGMPTEVSEVPAW : 541
PtIP-83Ce       : LVDSLEQVGHIVGAPEMPDMPSEADWSIFVNEIEAVAEGMPTEVSEVPAW : 541
PtIP-83Cf       : LVNSLEQVGQLVQAPVMPDMPSEADWSIFVNEVEAVAEGMPTEVSEVPAW : 541
PtIP-83Fa       : IVESLKNMGQLVEAPEMPEMPTDADWLIFVNEVEAVAEQVPTEVAEVPVW : 573
gi-598378568    : LLAAINDGGELGTLPEWPEMPTTTEWEIFENEVEAVAAGMPEEVSETLVW : 501
PtIP-83Aa_SSE   : HHHHHHHHHHHCCCCCCCCCCCHHHHHHHHHHHHHHCCCCCCCCCHHHH  : 556
PtIP-83Ca_SSE   : HHHHHHHHHHCCCCCCCCCCCHHHHHHHHHHHHHHCCCCCCCCCHHHH   : 541
PtIP-83Cb_SSE   : HHHHHHHHHHHCCCCCCCCCCCHHHHHHHHHHHHHHCCCCCCCCCHHHH  : 542
PtIP-83Cc_SSE   : HHHHHHHHCCCCCCCCCCCCHHHHHHHHHHHHHCCCCCCCCCHHHH     : 541
PtIP-83Cd_SSE   : HHHHHHHHCCCCCCCCCCCCHHHHHHHHHHHHHCCCCCCCCCHHHH     : 541
PtIP-83Ce_SSE   : HHHHHHHHCCCCCCCCCCCCHHHHHHHHHHHHHCCCCCCCCCHHHH     : 541
PtIP-83Cf_SSE   : HHHHHHHHHHCCCCCCCCCCCHHHHHHHHHHHHHHCCCCCCCCCHHHH   : 541

PtIP-83Fa_SSE   : HHHHHHHHCCCCCCCCCCCCCCHHHHHHHHHHHHHHCCCCCCCCCHHHH  : 573
gi-598378568    : HHHHHCCCCCCCCCCCCCCCCCCHHHHHHHHHHHHHHCCCCCHHHHHHH  : 501
                                                         helix-6
```

Fig. 2g

```
                       ---------------]   [--- MOTIF 17 ----] [----------
                                 *       620         *       640         *
PtIP-83Aa      : RAKCKNVAALGREMSITAVQMSELQYDIWVQGMMRDMARSQADRLAAIQP : 606
PtIP-83Ca      : KAKCKNMAALGREMSITAVQISELQYEIWVQGLMRDIARS ADRLAAIQP : 591
PtIP-83Cb      : KAKCKNVAALGREMCITAEQISQLQYDIWVQGLLRDIAQS ADRLAAIQP : 592
PtIP-83Cc      : KAKCKNMAALGREMSITAVQISELQYEIWVQGLMRDIARS ADRLAAIQP : 591
PtIP-83Cd      : KAKCKNMAALGREMSITAVQISELQYEIWVQGLMRDIARS ADRLAAIQP : 591
PtIP-83Ce      : KAKCKNMAALGREMSITAVQISELQYEIWVQGLMRDIARS ADRLAAIQP : 591
PtIP-83Cf      : KAKCKNVAALGREMSITAVQISELQYDIWVQGMMRDIAQSQADRLAAIQP : 591
PtIP-83Fa      : KAKCKNVAVLGQAMCTTAAYISELQYQITVEKMLQEIAQRQADRLVGISA : 623
gi-598378568   : KAKCKNVAAIGREMVTQAMLVSQLEYDIKVHSLLQEVAQNQAARLEAIQP : 551
PtIP-83Aa_SSE  : HHHHHHHHHHHHHHHHHHHHHHHHHHHHHHHHHHHHHHHHH HHHHHCCC : 606
PtIP-83Ca_SSE  : HHHHHHHHHHHHHHHHHHHHHHHHHHHHHHHHHHHHHHHHH HHHHHCCCC : 591
PtIP-83Cb_SSE  : HHHHHHHHHHHHHHHHHHHHHHHHHHHHHHHHHHHHHHHHH HHHHHHCC : 592
PtIP-83Cc_SSE  : HHHHHHHHHHHHHHHHHHHHHHHHHHHHHHHHHHHHHHHHH HHHHHCCCC : 591
PtIP-83Cd_SSE  : HHHHHHHHHHHHHHHHHHHHHHHHHHHHHHHHHHHHHHHHH HHHHHCCCC : 591
PtIP-83Ce_SSE  : HHHHHHHHHHHHHHHHHHHHHHHHHHHHHHHHHHHHHHHHH HHHHHCCCC : 591
PtIP-83Cf_SSE  : HHHHHHHHHHHHHHHHHHHHHHHHHHHHHHHHHHHHHHHHH HHHHHHCCC : 591
PtIP-83Fa_SSE  : HHHHHHHHHHHHHHHHHHHHHHHHHHHHHHHHHHHHHHHHH HHHHHHHH : 623
gi-598378568   : HHHHHHHHHHHHHHHHHHHHHHHHHHHHHHHHHHHHHHHHH HHHHHHCC : 551

------------- MOTIF 6 -----------------]   [-------
                            660         *        680         *       700
PtIP-83Aa      : ADLTNYLEMATQMDMRTTRMLLGLLNILRIQNAALRYEYLLMP-TELTTW : 655
PtIP-83Ca      : VDLTNHLEMATHMDMRTTSMLIGLLNMLRIQNAALMYEYLLTP-TELTVW : 640
PtIP-83Cb      : ANLTNYLEMAIQMDMRTTRILIGLLNIMRIQNAALMYEYLLTP-TQLTAW : 641
PtIP-83Cc      : VDLTNHLEMATHMDMRTTSMLIGLLNMLRIQNAALMYEYLLTP-TELTVW : 640
PtIP-83Cd      : VDLTNHLEMATHMDMRTTSMLIGLLNMLRIQNAALMYEYLLTP-TELTVW : 640
PtIP-83Ce      : VDLTNHLEMATHMDMRTTSMLIGLLNMLRIQNAALMYEYLLTP-TELTVW : 640
PtIP-83Cf      : ADLTNFLEMATQMDMRTTRMLIGLLNMLRIQNAALMYEYLLTP-TELTAW : 640
PtIP-83Fa      : ADLSSYTEMASQIDMRTTRILLELIKMLYIQNAAIKYEYLYDANEKLNSW : 673
gi-598378568   : TDLIDYQEMAAQLDMRTSRILLSLLQVLALQNGALTYSYLMPR-TSLSAR : 600
PtIP-83Aa_SSE  : CCCCHHHHHHHHHHHHHHHHHHHHHHHHHHHHHHHHHHHHHCCC-CCCCCC : 655
PtIP-83Ca_SSE  : CCCCHHHHHHHHHHHHHHHHHHHHHHHHHHHHHHHHHHHHHCCCCC-CCCCCC : 640
PtIP-83Cb_SSE  : CCCCCHHHHHHHHHHHHHHHHHHHHHHHHHHHHHHHHHHHHCCCCC-CCCCCC : 641
PtIP-83Cc_SSE  : CCCCHHHHHHHHHHHHHHHHHHHHHHHHHHHHHHHHHHHHHCCCC-CCCCCC : 640
PtIP-83Cd_SSE  : CCCHHHHHHHHHHHHHHHHHHHHHHHHHHHHHHHHHHHHHHCCCC-CCCCCC : 640
PtIP-83Ce_SSE  : CCCHHHHHHHHHHHHHHHHHHHHHHHHHHHHHHHHHHHHHHCCCC-CCCCCC : 640
PtIP-83Cf_SSE  : CCCCHHHHHHHHHHHHHHHHHHHHHHHHHHHHHHHHHHHHHCCCC-CCCCCC : 640

PtIP-83Fa_SSE  : CCCHHHHHHHHHHHHHHHHHHHHHHHHHHHHHHHHHHHHCCCCCCCCCCCC : 673
gi-598378568   : CCHHHHHHHHHHHHHHHHHHHHHHHHHHHHHHHHHHHHHCCCCC-CCCCCC : 600
```

Fig. 2h

```
              --- MOTIF 12 ----------------][-------- MOTIF 4
                        *         720         *         740         *
PtIP-83Aa       : PLG--MDTVGDLLIAQENAALIGLMQLGPSSDFTSRHVVKDIPVNLLLDG : 703
PtIP-83Ca       : PLG--MDTVANLLIAQENAALVGLIQLGQSSNFTSRHVVKGIPVSLLLDG : 688
PtIP-83Cb       : PLR--MDTVANLLITHESAALSGLAQLGPPSDFTSRHVVKGIPVSLLLDG : 689
PtIP-83Cc       : PLG--MDTVANLLIAQENAALVGLIQLGPSSNFTSRHVVKGIPVSLLLDG : 688
PtIP-83Cd       : PLG--MDTVANLLIAQENAALVGLIQLGPSSNFTSRHVVKGIPVSLLLDG : 688
PtIP-83Ce       : PLG--MDTVANLLIAQENAALVGLIQLGPSSNFTSRHVVKGIPVSLLLDG : 688
PtIP-83Cf       : PLG--MDTVGNLLIAQENAALLGLTQLGPSSDFTSRHVVKGIPVSLLLDG : 688
PtIP-83Fa       : PVS--METVWTMLLQQENAALLDLGPTNDFTVTYAVKDIPTKLLVDG : 721
gi-598378568    : SVSATMSAVWGLLLHQGQATLVALGELGSPSTRSVEYVVKGIPVGLLLDG : 650
PtIP-83Aa_SSE   : CCC--CCHHHHHHHHHHHHHHHHHCCCCCCCCCCCCCCCCCCHHHCCCC : 703
PtIP-83Ca_SSE   : CCC--CCHHHHHHHHHHHHHHHHHHCCCCCCCCCCCCCCCCCCCCCCCC : 688
PtIP-83Cb_SSE   : CCC--HHHHHHHHHHHHHHHHHHHHHCCCCCCCCCCCCCCCCCCCCCCC : 689
PtIP-83Cc_SSE   : CCC--CCHHHHHHHHHHHHHHHHHCCCCCCCCCCCCCCCCCCCCCCCCC : 688
PtIP-83Cd_SSE   : CCC--CCHHHHHHHHHHHHHHHHHCCCCCCCCCCCCCCCCCCCCCCCCC : 688
PtIP-83Ce_SSE   : CCC--CCHHHHHHHHHHHHHHHHHCCCCCCCCCCCCCCCCCCCCCCCCC : 688
PtIP-83Cf_SSE   : CCC--CCHHHHHHHHHHHHHHHHHCCCCCCCCCCCCCCCCCCCCCCCCC : 688
PtIP-83Fa_SSE   : CCC--HHHHHHHHHHHHHHHHHHHCCCCCCCCCCEEEEEECCCCCCCCC : 721
gi-598378568    : CHHHHHHHHHHHHHHHHHHHHHHHHCCCCCCCCCCCCEECCCCCCCCCC : 650

----------------] [---- MOTIF 16 -----]    [----
                           760         *        780         *        800
PtIP-83Aa       : EDW  F IPVQAGMSSFPSSWSRVRIRHL MHFVKEA--SGIGG-EIIHQP : 750
PtIP-83Ca       : EDW  F IPVQAGMSSFPFNWTRVRIRHL MQFA EA--SGGGGGEIIHQP : 736
PtIP-83Cb       : GDW  F IPVQGGMSSFPSSWTRVRIRHL MHFV EA--SGGG--EIIHQP : 735
PtIP-83Cc       : EDW  F IPVQAGMSSFPFNWTRVRIRHL MQFA EA--SGGD--EIIHQP : 734
PtIP-83Cd       : EDW  F IPVQAGMSSFPFNWTRVRIRHL MQFA EA--SGGD--EIIHQP : 734
PtIP-83Ce       : EDW  F IPVQAGMSSFPFNWTRVRIRHL MQFA EA--SGGD--EIIHQP : 734
PtIP-83Cf       : EDW  F IPVQGGMSSFPSSWTRVRIRHL MHFV ES--MNGGG-EIIHQP : 735
PtIP-83Fa       : FDWNF  IAVED-SAIFPSGWSRVRIRYV LKFD QG--ADSSN-IVIHQP : 767
gi-598378568    : EDWDFTIPVAD-TLHFPSTWSRVRISHV MKFVKTGGTAAGRDEELVHQP : 699
PtIP-83Aa_SSE   : CEE  E EECCCCCCCCCCCCCCCCEEE EEEE CC--CCCCC-CCCCCC : 750
PtIP-83Ca_SSE   : CCE  E EECCCCCCCCCCCCCCEEEEE EEEE CC--CCCCCCCCCCC : 736
PtIP-83Cb_SSE   : CEE  E EECCCCCCCCCCCCCEEEEEE EEEE CC--CCCC--CCCCCC : 735
PtIP-83Cc_SSE   : CCE  E ECCCCCCCCCCCCCCCCEEEEEE EEEECCC--CCCC--CCCCCC : 734
PtIP-83Cd_SSE   : CCE  E ECCCCCCCCCCCCCCCCEEEEEE EEEE CC--CCCC--CCCCCC : 734
PtIP-83Ce_SSE   : CCE  E ECCCCCCCCCCCCCCCCEEEEEE EEEECCC--CCCC--CCCCCC : 734
PtIP-83Cf_SSE   : CEE  E ECCCCCCCCCCCCCCCCEEEEEE EEEE CC--CCCCC-CCCCCC : 735
PtIP-83Fa_SSE   : CCE  E ECCC-CCCCCCCCCEEEEEE EEEE CC--CCCCC-CCCCCC : 767
gi-598378568    : CEE  E ECCCC-CCCCCCCCCCEEEEEE EEEE CCCCCCCCCCCCCCCC : 699
```

Fig. 2i

```
                 ---------------- MOTIF 5 ------------------]  [--
                        *         820         *         840         *
PtIP-83Aa       : TTQTGTVYILL GSTIFHDRRRDQVLPF AAAPLNYHYAYRLDTGDSTLT : 800
PtIP-83Ca       : STRSGIVYILL GSTIFHDRRRDEVMTF AADPLNF YAYRLDTGEATLT  : 786
PtIP-83Cb       : ATQTGTIYILL GSTVFHDRRREEVMTF AAVPLNYHYAYRLDTGEATLT : 785
PtIP-83Cc       : STRSGIVYILL GSTIFHDRRRDEVMTF AADPLNF YAYRLDTGEATLT  : 784
PtIP-83Cd       : STRSGIVYILL GSTIFHDRRRDEVMTF AADPLNF YAYRLDTGEATLT  : 784
PtIP-83Ce       : STRSGIVYILL GSTIFHDRRRDEVMTF AADPLNF YAYRLDTGEATLT  : 784
PtIP-83Cf       : ATQTGTVYILL GSTIFHDRRRDEVMTF AAAPLNY YAYRLDTGETTLT  : 785
PtIP-83Fa       : STNTGLVYMLL GSRFLHDRKHEEVMDY ASLGPVYAYAYDLNTGATTLN : 817
gi-598378568    : TTDTGKVYIVLRSELFFQDRRKGQYFKY ATVPAIYHYAYNLATSETTED : 749
PtIP-83Aa_SSE   : CCCCEEEEEE CCCCEECCCCCCCCCCCCCCEE EEEEECCCCCCCC : 800
PtIP-83Ca_SSE   : CCCCEEEEEE CCCCCCCCCCCEEEE ECCCCCE EEEECCCCCCCCC : 786
PtIP-83Cb_SSE   : CCCCCEEEEECCCCEEECCCCCCEEEE ECCCCEE EEECCCCCCCCC : 785
PtIP-83Cc_SSE   : CCCCCEEEEE CCCEEECCCCCCEEEE ECCCEEE EEECCCCCCCCC : 784
PtIP-83Cd_SSE   : CCCCCEEEEE CCCEEECCCCCCEEEE ECCCEEE EEECCCCCCCCC : 784
PtIP-83Ce_SSE   : CCCCCEEEEE CCCEEECCCCCCEEEE ECCCEEE EEECCCCCCCCC : 784
PtIP-83Cf_SSE   : CCCCEEEEEE CCCEEECCCCCCEEEE ECCCCEE EEECCCCCCCCC : 785
PtIP-83Fa_SSE   : CCCCCCEEEEECCCCCCCCCCCCCCEEECCCCCCE EEECCCCCCCCC : 817
gi-598378568    : CCCCCEEEEECCCCCCCCCCCCCCEEEE EECCEEE EEECCCCCCCCC : 749

MOTIF 23 ] [------------------MOTIF 3 --------------
                   860         *         880         *         900
PtIP-83Aa       : NEPSEQFANKFMQMTPFTRWRLRLSASAKENAGLAFPTATALDSTT IVI : 850
PtIP-83Ca       : NEPSEDFANTFMQMTPFTRWRLRLSASASENAELAFPTATAPDSTT VVI : 836
PtIP-83Cb       : NEPSEQFANTFMQMTPFTHWRLRLSASAAENKGLAFPTATAPDSTT IAI : 835
PtIP-83Cc       : NEPSEEFANTFMQMTPFTRWRLRLSASASENAELAFPTATAPDSTT VVI : 834
PtIP-83Cd       : NEPSEEFANTFMQMTPFTRWRLRLSASASENAELAFPTATAPDSTT VVI : 834
PtIP-83Ce       : NEPSEEFANTFMQMTPFTRWRLRLSASASENAELAFPTATAPDSTT VVI : 834
PtIP-83Cf       : NQPSEHFANTFMQMTPFTRWRLRLSASAPENAGLAFPTATALDSTT IVI : 835
PtIP-83Fa       : NIPSQQYANTFMQMTPFNAWRLRLSASAVENQGLVFPTATSPDNTT ISI : 867
gi-598378568    : NRPDEEFARVFMRMTPFTRWKLRVSTSARENQGLAFPTAITPDATT IVI : 799
PtIP-83Aa_SSE   : CCCHHHHCCCCCCCCCCCEEEEEECCCCCCCCCCCCCCCCEEEEE EEE : 850
PtIP-83Ca_SSE   : CCCCCCCCCCCCCCCCCCEEEEEECCCCCCCCCCCCCCCCCCCEE EEE : 836
PtIP-83Cb_SSE   : CCCCCCCCCCCCCCCCCCEEEEEECCCCCCCCCCCCCCCCCCCEE EEE : 835
PtIP-83Cc_SSE   : CCCCCCCCCCCCCCCCCCEEEEEECCCCCCCCCCCCCCCCCCCEE EEE : 834
PtIP-83Cd_SSE   : CCCCCCCCCCCCCCCCCCEEEEEECCCCCCCCCCCCCCCCCCCEE EEE : 834
PtIP-83Ce_SSE   : CCCCCCCCCCCCCCCCCCEEEEEECCCCCCCCCCCCCCCCCCCEE EEE : 834
PtIP-83Cf_SSE   : CCCCCCCCCCCCCCCCCCEEEEEECCCCCCCCCCCCCCCCCCCEE EEE : 835
PtIP-83Fa_SSE   : CCCCCCCCCCCCCCCCCCEEEEEECCCCCCCCCCCCCCCCCCCEE EEE : 867
gi-598378568    : CCCCCCCCCCCCCCCCCCEEEEEECCCCCCCCCCCCCCCCCCCEE EEE : 799
```

Fig. 2j

```
                        -------]
                               *          920
PtIP-83Aa      :  TFHVTAIR IDWRHDEE---    : 867
PtIP-83Ca      :  TFHVTAIR VDWRQEEE---    : 853
PtIP-83Cb      :  TFHVTAIR IDWRQEEE---    : 852
PtIP-83Cc      :  TFHVTAIR VDWRQEEE---    : 851
PtIP-83Cd      :  TFHVTAIR VDWRQEEE---    : 851
PtIP-83Ce      :  TFHVTAIR VDWRQEEKEEE    : 854
PtIP-83Cf      :  TFHVTAIR IDWRHEEE---    : 852
PtIP-83Fa      :  TFYVTAIRRIDHRQEGDVE-    : 886
gi-598378568   :  RFYLSAIRDFDWNR------    : 813
PtIP-83Aa_SSE  :  EEEEEEEE EECCCCCC---    : 867
PtIP-83Ca_SSE  :  EEEEEEEE CCCCCCCC---    : 853
PtIP-83Cb_SSE  :  EEEEEEEE ECCCCCCC---    : 852
PtIP-83Cc_SSE  :  EEEEEEEE CCCCCCCC---    : 851
PtIP-83Cd_SSE  :  EEEEEEEE CCCCCCCC---    : 851
PtIP-83Ce_SSE  :  EEEEEEEE CCCCHHHHCC     : 854
PtIP-83Cf_SSE  :  EEEEEEEE ECCCCCCC---    : 852
PtIP-83Fa_SSE  :  EEEEEEEECCCCCCCCCCC-    : 886
gi-598378568   :  EEEEEEEECCCCCC------    : 813
```

Fig. 3a

```
              1                                                  50
PtIP-50Aa  (1) MAAGDYSVLYQDVNQISIR-LEKMDFSEVMAVHRMFVRMDDLDVSSGTGL
PtIP-83Aa  (1) MALVDYGKLFEDLNQISMGVLDRVEFSEVMVIHRMYVRLADLNV----GQ 51                                                100
PtIP-50Aa (50) LSGAEKVKRLYVFADVVELPSKQLRLP----GTDLIVILCRIFVTNGR--
PtIP-83Aa (47) LEGAEKVKRLYVFADVVELPVVEWRWPPQIPGSVTVIILCRLLQWPTDGR 101                                               150
PtIP-50Aa (94) -HSTELFLPSMNMSMVAPGTG------------------SIRGVILSPT
PtIP-83Aa (97) QSDTELHLTFMKLHAIQREENRWEITAADGMNWGVYIHAEEVQVGVLTMS 151                                               200
PtIP-50Aa (124) TVLTTSSDALQFKLQSGS----MTSVMRLKDVSVAATLTCNVQAASASMP
PtIP-83Aa (147) WSSVLRVSALRSVITSGFRAVSVFEVPGSVRSTLGATLRPDHALYSTTMQ 201                                               250
PtIP-50Aa (170) LTVKTTGTSPGNICVLGMSTAVVVPES----------------AVAVIT
PtIP-83Aa (197) ATPNASHISAFNLRIVSPSAYRVCPLQNDTDTYLGIPADVAAVLPVDVVT 251                                               300
PtIP-50Aa (203) DANILLGMQVTVLIAELVKIAHNSDVLIAAVTRHVEWLNHLLVQAHAAAP
PtIP-83Aa (247) DPNILLGMQTTVHIAELVKACHPSPDVVSAVGEHLNWLNKLLLPLKESTQ

301                            ↓                  350
PtIP-50Aa (253) S------EDVVALLYRTQGFIKLRNEGLIVPRLQYRMYKDLIDRMVQVAQ
PtIP-83Aa (297) LQGSESYKECLALLGRVHAAMKMVRIGLVVPQLQYRMYGSLINQMAQVAQ 351                                               400
PtIP-50Aa (297) SYDQDFKQLKLFVEQNKILGSYLLEQNKAFAEKEKDMDAFHSQVIDLRTS
PtIP-83Aa (347) NYDREFKQFKLFIIQNQILGSYLLQQNRAFAERELQMESFHAAVISQRRE 401                                               450
PtIP-50Aa (347) ELESTIERMDDLSKQMEEQNAAMEQAKADMDAGLIAYQNKQVANAVFAVL
PtIP-83Aa (397) ELDNTFAKMDRLSGQMEAESSAMEQAKKEMDEGLRQFQNRQVANALFAVL

451            ↓  ↓                               500
PtIP-50Aa (397) GAIASIGLAFATGGATAPGAVASAGAAVTAAGKAAEGLKKVVEILEGLQA
PtIP-83Aa (447) SAVAQIGLAFLTAGATAPGAVASAGQAVSIAGQAAQGLRRVVEILEQLEA 501                                               550
PtIP-50Aa (447) VMEVVAVIKELVQSLQEIGQLVDAPEMPDLPSDAEWEIFVNEVEAVAEQM
PtIP-83Aa (497) VMEVVAAVKDLVDSLEQVGQIVDAPVMPELPSEADWSIFVNEVEAVAEGM 551                                               600
PtIP-50Aa (497) PTEVTEVPAWKAKCKNVAALGREMSTMAAHIAELQFEIQVQEMLREIAKK
PtIP-83Aa (547) PTEVSEVPVWRAKCKNVAALGREMSITAVQMSELQYDIWVQGMMRDMARS
```

Fig. 3b

```
              601  ↓   ↓                                             650
PtIP-50Aa (547) QADRLSSIKPADLTNYLEMVSEMDMRTTRMLLELIRVLYIQNAALQYEYL
PtIP-83Aa (597) QADRLAAIQPADLTNYLEMATQMDMRTTRMLLGLLNILRIQNAALRYEYL 651                                                    700
PtIP-50Aa (597) QTPAPLNAWPVTMQTVWGLLVQQETAAINGLLQMGAPSDYTQEYAVRDVP
PtIP-83Aa (647) LMPTELTTWPLGMDTVGDLLIAQENAALIGLMQLGPSSDFTSRHVVKDIP

701           ˇ                                        750
PtIP-50Aa (647) VRLLLGGGDWEFELPVRN--ADFPLTWCRVRIRYVDMRFDAAAE------
PtIP-83Aa (697) VNLLLDGEDWEFEIPVQAGMSSFPSSWSRVRIRHLEMHFVKEASGIGGEI

751↓                                                   800
PtIP-50Aa (689) -HLPVTSTGEVYMLLQSSRFFEDRAKRENEFISYEGGMGLQYQYAYRLAT
PtIP-83Aa (747) IHQPTTQTGTVYILLQGSTIFHDRRR--DQVLPFQAAAPLNYHYAYRLDT

801                        ↓                           850
PtIP-50Aa (738) GDATVTNVPSEEYANTFMRLAPFTRWRLRLSASAPENKGLAFPTATLADA
PtIP-83Aa (795) GDSTLTNEPSEQFANKFMQMTPFTRWRLRLSASAKENAGLAFPTATALDS 851              873
PtIP-50Aa (788) TTRIKITFHVSAIRRISTRVAV-
PtIP-83Aa (845) TTQIVITFHVTAIRQIDWRHDEE
```

Fig. 4a

```
              1                                                  50
PtIP-83Aa  (1) MALVDYGKLFEDLNQISMGVLDRVEFSEVMVIHRMYVRLADLNVG----Q
PtIP-50Aa  (1) MAAGDYSVLYQDVNQISIR-LEKMDFSEVMAVHRMFVRMDDLDVSSGTGL
PtIP-50Ba  (1) MADLDYSKLYQDLNQISVR-LEKTEFSEVMVVHRMFVRMDDLDVSSGSGL
PtIP-50Bb  (1) MADIDYSVLYNDVNQISIR-LERMDFSEVMAVHRMFVRMDDLDVSSGTGV
PtIP-83Fa  (1) ---MEYSSLYGDVNQVSLR-FQNMEFSEVMVVHRMHVRLEELDMTG----

51                                                 100
                   [--Motif A --]
PtIP-83Aa  (47)  LEGAEKVKRLYVFADVVELPVVEWRWP--PQIPGSVTVIILCRLLQWPTD
PtIP-50Aa  (50)  LSGAEKVKRLYVFADVVELPSKQ------LRLPGTDLIVILCRIFVT--N
PtIP-50Ba  (50)  LSGAEKVKRLYVFADVVELPSKQ------VRLAGTDMIVVFCRIFVP--E
PtIP-50Bb  (50)  LEGAQNVKRLYVFADVVELPSKQ------VRLPGSDMIVILCRIFVR--N
PtIP-83Fa  (43)  VEGIEKVKRLYVLADVVELPSTATQVFQYLRLPASISAIILCRVLYIPEV 101                                                150
PtIP-83Aa  (95)  GRQ---SDTELHLTFMKLHAIQREENRW----EITAADGMNWGVYIHAEE
PtIP-50Aa  (92)  GR----HSTELFLPSMNMSMVAPG--------------------------
PtIP-50Ba  (92)  GR----HYAELFLPSMNMSMVGADG-------------------------
PtIP-50Bb  (92)  GR----HNTELFLPSMNMSMVAAG--------------------------
PtIP-83Fa  (93)  DQRPHMAQCSLDFPFMRLHVVGSVHENVGGVMQAFSSDATPSNIGIYLHA 151                                                200
PtIP-83Aa  (138) VQVGVLTMSWSSVLRVSALRSVITSGFRAVSVFEVPGSVRSTLGATLRPD
PtIP-50Aa  (112) -TGSIRGVILSPTTVLTTSSDALQFKLQSGSMTSVMRLKDVSVAATLTCN
PtIP-50Ba  (113) -EGSIRGVILSP-TVLTTLSNALQFRLECGSMTSVMRLNDVSAGATLTCN
PtIP-50Bb  (112) -NGTIRGVNLST-TMSSSSSNALQFNLRSGSMTSTVRLKDVDVAAALTCD
PtIP-83Fa  (143) DRFIYRQATSPASNFVLPLDVRVSFGSSTYSGPTIRPDWQNLNVSNISYG 201                                                250
PtIP-83Aa  (188) HALYSTTMQATPNASHISAFNLRIVSPSAYRVCPLQNDTDTYLGIPADVA
PtIP-50Aa  (161) VQAASASMPLTVKTTGTSPGNICVLGMSTAVVPES---------------
PtIP-50Ba  (161) VQAASACVPLKVKTTGTSPGNICVLGLSTAAVVPES--------------
PtIP-50Bb  (160) VQAASASMPLTVMTTGTSPGNIWVLGMTTAVVIPES--------------
PtIP-83Fa  (193) PQHLSKGPPLTSSDSDLQRSDEIELLAQQDVWSPLLHVAFSPTALPGNIP 251                                                300
PtIP-83Aa  (238) AVL-------------------PVDVVTDPNILLGMQTTVHIAELVKACH
PtIP-50Aa  (197) ----------------------AVAVITDANILLGMQVTVLIAELVKIAH
PtIP-50Ba  (197) ----------------------VVAVITDANILLGMQVTVLIAELVKIAH
PtIP-50Bb  (196) ----------------------AVAVITDANILLGMQVTVLIAELVKTAH
PtIP-83Fa  (243) GTQGLFRPSSACSFFHVPPPDVPANVLTDPSIILGMQMNMLIAELVLAAH 301                                                350
PtIP-83Aa  (269) PSPDVVSAVGEHLNWLNKLLLPLKESTQLQGSESYKECLALLGRVHAAMK
PtIP-50Aa  (225) NSDVLIAAVTRHVEWLNHLLVQAHAAAPS------EDVVALLYRTQGFIK
PtIP-50Ba  (225) NSDGVIAAVTRHVEWLNHLLVQAQAAAPS------EDVVALLYRTQAFIK
PtIP-50Bb  (224) NSDVIIAAITRHVEWLNHLLVQAHAAAPN------EDVITLLYRTQAFIK
PtIP-83Fa  (293) NSPQVMNVITKHVLWLNKILLQVASPNDD--------ILALLFRIQAFMK
```

Fig. 4b

```
              351                                              400
                                                          [----
PtIP-83Aa (319) MVRIG-LVVPQLQYRMYGSLINQMAQVAQNYDREFKQFKLFIIQNQILGS
PtIP-50Aa (269) LRNEG-LIVPRLQYRMYKDLIDRMVQVAQSYDQDFKQLKLFVEQNKILGS
PtIP-50Ba (269) LRKEG-LIVPRLQYHMYKDLIDRMVQVAQSYDQDFKQMKLYVEQNKILGS
PtIP-50Bb (268) LKREG-LVVPRLQYHMYKNLIDRMVQVAQNYDQDFRQLKLFVEQNKILGS
PtIP-83Fa (335) MAKQPRFVVPRLQYHMYGSLINRMVQVAQNYDQEFKQLKLFIAQNEILGS 401                                              450
             Motif B ]
PtIP-83Aa (368) YLLQQNRAFAERELQMESFHAAVISQRREELDNTFAKMDRLSGQMEAESS
PtIP-50Aa (318) YLLEQNKAFAEKEKDMDAFHSQVIDLRTSELESTIERMDDLSKQMEEQNA
PtIP-50Ba (318) YLLEQNKAFAEKEKDMDASHSQVIALRTSELQSTIERMDDLSKQMEVQST
PtIP-50Bb (317) YLLEQNKAFAEKEKDMDAFHSQIIALRTTELNNTIERMGELSKQMDQENE
PtIP-83Fa (385) YLLQQNRAFAEREKEMSAFHSQVVSMRRSELQSAIQTMDNLSLQMESESE 451                                              500
PtIP-83Aa (418) AMEQAKKEMDEGLRQFQNRQVANALFAVLSAVAQIGLAFLTAGATAPGAV
PtIP-50Aa (368) AMEQAKADMDAGLIAYQNKQVANAVFAVLGAIASIGLAFATGGATAPGAV
PtIP-50Ba (368) AMEKAKADMDAGLIVYQNKQVADAVFAVMEAIASIGLAFATGGATAPGAV
PtIP-50Bb (367) AMEQAKADMDAGLIEYQNRQVANALFAVLGAIASIGLAFATGGATAPGAV
PtIP-83Fa (435) AMNEAQENMVEAIQEYERKLLARALFSVIGAIASVALAFATGGATAPGAV 501                                              550
PtIP-83Aa (468) ASAGQAVSIAGQAAQGLRRVVEILEQLEAVMEVVAAVKDLVDSLEQVGQI
PtIP-50Aa (418) ASAGAAVTAAGKAAEGLKKVVEILEGLQAVMEVVAVIKELVQSLQEIGQL
PtIP-50Ba (418) ASAGAAVSAAGKAGEGLKKVVEILEGLQAIMEVIAAIKGLVQSLQKIGQL
PtIP-50Bb (417) SAAGAAVTAAGKAAEGLKKVVEILEGLQVVMEVVAAIKELVQSLQQIGQL
PtIP-83Fa (485) AAAGGAVAAAGRLAAGLQKVVDILQGLQAVMEVVVAIRDIVESLKNMGQL 551                                              600
                                                       [Motif C]
PtIP-83Aa (518) VDAPVMPELFSEADWSIFVNEVEAVAEGMPTEVSEVPVWRAKCKNVAALG
PtIP-50Aa (468) VDAPEMPDLPSDAEWEIFVNEVEAVAEQMPTEVTEVPAWKAKCKNVAALG
PtIP-50Ba (468) VNAPEMPDLPSEAEWEMFVKEVEAVAAQMPTEVTQVPAWTAKCKNVAALG
PtIP-50Bb (467) VDAPEMPDLPSNADWEIFVNEVEAVAEQMPTEVTQVAAWKAKCKNVAALG
PtIP-83Fa (535) VEAPEMPEMPTDADWLIFVNEVEAVAEQVPTEVAEVPVWKAKCKNVAVLG 601                                              650
PtIP-83Aa (568) REMSITAVQMSELQYDIWVQGMMRDMARSQADRLAAIQPADLTNYLEMAT
PtIP-50Aa (518) REMSTMAAHIAELQFEIQVQEMLREIAKKQADRLSSIKPADLTNYLEMVS
PtIP-50Ba (518) REMSTTAAHIAELQYEIQVQGMLQQIAKKQADRLSSIKPADLTNYFEMVS
PtIP-50Bb (517) REMSTMAAHIAELQYQIQVQEMLREIAQKQADRLSSISPADLTNYLEMVS
PtIP-83Fa (585) QAMCTTAAYISELQYQITVEKMLQEIAQRQADRLVGISAADLSSYTEMAS
```

Fig. 4c

```
              651                                            700
                                             [ Motif D ]
PtIP-83Aa (618) QMDMRTTRMLLGLLNILRIQNAALRYEYLLMP-TELTTWPLGMDTVGDLL
PtIP-50Aa (568) EMDMRTTRMLLELIRVLYIQNAALQYEYLQTP-APLNAWPVTMQTVWGLL
PtIP-50Ba (568) EMDMRTTRMLLELIQVLNIQNGALRYEYLQPA-APLNAWPVTMQTVWGLL
PtIP-50Bb (567) QMDMRTTRMLLELIRVLYIQNAALQYEYLQTP-APLNAWPVAMQTVWGLL
PtIP-83Fa (635) QIDMRTTRILLELIKMLYIQNAAIKYEYLYDANEKLNSWPVSMETVWTML 701                                            750
PtIP-83Aa (667) IAQENAALIGLMQLGPSSDFTSRHVVKDIPVNLLLDGEDWEFEIPVQAGM
PtIP-50Aa (617) VQQETAAINGLLQMGAPSDYTQEYAVRDVPVRLLLGGGDWEFELPVRN--
PtIP-50Ba (617) VQQEAAAINGLLQLGAPSDFTREYVVGDIPVKLLLGGGDWEFELPVTD--
PtIP-50Bb (616) IQQETTAITGLLQLGAPSDFTQEYVVKDIPVSLLLEGRDWEFELPVLN--
PtIP-83Fa (685) LQQENAALLGLLDLGPTNDFTVTYAVKDIPTKLLVDGFDWNFEIAVEDS- 751                                            800
PtIP-83Aa (717) SSFPSSWSRVRIRHLEMHFVKEASGIGGEIIHQPTTQTGTVYILLQGSTI
PtIP-50Aa (665) ADFPLTWCRVRIRYVDMRFDAAAE------HLPVTSTGEVYMLLQSSRF
PtIP-50Ba (665) ADFPLTWCRVRIQHVDMQFDAAAE------HLPTTSTGEVYMLLQSSRF
PtIP-50Bb (664) ADFPSTWSRVRIHHVDMQFDAAATSI-----HIPTTNTGVVYLLLQSSRF
PtIP-83Fa (734) AIFPSGWSRVRIRYVELKFDQQGADSSNIVIHQPSTNTGLVYMLLQGSRF 801                                            850
                [--- Motif E ----]
PtIP-83Aa (767) FHDRRR--DQVLPFQAAAPLNYHYAYRLDTGDSTLTNEPSEQFANKFMQM
PtIP-50Aa (708) FEDRAKRENEFISYEGGMGLQYQYAYRLATGDATVTNVPSEEYANTFMRL
PtIP-50Ba (708) FEDRAQHEDEFISYEAGTGLQYQYAYRLATGEATVTNVPSEAYVNTFMLL
PtIP-50Bb (709) FDDRARRANEFISYEAGTGLFYQYAYRLATGEATVTNIPTDEYANTFMRL
PtIP-83Fa (784) LHDRKH--EEVMDYEASLGPVYAYAYDLNTGATTLNNIPSQQYANTFMQM 851                                            900
PtIP-83Aa (815) TPFTRWRLRLSASAKENAGLAFPTATALDSTTQIVITFHVTAIRQIDWRH
PtIP-50Aa (758) APFTRWRLRLSASAPENKGLAFPTATLADATTRIKITFHVSAIRRISTRV
PtIP-50Ba (758) APFTRWRLRLSSSAPENKGLAFPTATSADATTRIKITFHVSAIRRISLAR
PtIP-50Bb (759) TPFTRWRLRLSLSAEENAGLAFPTATSADDTTQIKITFHVSAIRRISTRS
PtIP-83Fa (832) TPFNAWRLRLSASAVENQGLVFPTATSPDNTTQISITFYVTAIRRIDHRQ 901
PtIP-83Aa (865) DEE--
PtIP-50Aa (808) AV---
PtIP-50Ba (808) -----
PtIP-50Bb (809) DGVSS
PtIP-83Fa (882) EGDVE
```

Fig. 5a

```
                1                                                50
PtIP-83Aa  (1)  -MALVDYGKLFEDLNQISMGVLDRVEFSEVMVIHRMYVRLADLNVGQLEG
PtIP-83Ca  (1)  ----MDYSTLYRDLNQISIG-VDRVEFSEVMVIHRMYVRLSDLNVGELPG
PtIP-83Cb  (1)  ----MDYSTLYRDLNQISMP-LDRVEFSEVMVIHRMYLRLSDLNVGELPG
PtIP-83Cc  (1)  ----MDYSTLYRDLNQISIG-VDRVEFSEVMVIHRMYVRLSDLNVGELPG
PtIP-83Cd  (1)  ----MDYSTLYRDLNQISIG-VDRVEFSEVMVIHRMYVRLSDLNVGELPG
PtIP-83Ce  (1)  ----MDYSTLYRDLNQISIG-VDRVEFSEVMVIHRMYVRLSDLNVGELPG
PtIP-83Cg  (1)  ----MDYSTLYRDLNQISMP-LDRVEFSEVMVIHRMYLRLSDLNVGELPG
PtIP-83Cf  (1)  MASVLDYSTLYRDLNQISMA-VDQVEFSEVMVIHRMYVNLADLDVAELVG
PtIP-83Da  (1)  ----MDYSTLYRDLNQISIG-VDRVEFSEVMVIHRMYVRLSDLNVGELPG 51                                               100
PtIP-83Aa  (50) AEKVKRLYVFADVVELPVVEWR--WPPQIPGSVTVIILCRLLQWPTDGRQ
PtIP-83Ca  (46) AGRVKRVYVFADVVELAPRAT-LRDQMHMPGSVTVIVLCRLLQFPIDGSQ
PtIP-83Cb  (46) AERVKRLYVLADVVELATFAHPQLLNTRMPGSVTVIILCRLLQFPTDGSF
PtIP-83Cc  (46) AGRVKRVYVFADVVELAPRAT-LRDQMHMPGSVTVIVLCRLLQFPIDGSQ
PtIP-83Cd  (46) AGRVKRVYVFADVVELAPRET-LRDQMHMPGSVTVIILCRLLQFPIDGSQ
PtIP-83Ce  (46) AGRVKRVYVFADVVELAPRAT-LRDQMHMPGSVTVIVLCRLLQFPIDGSQ
PtIP-83Cg  (46) AERVKRLYVFADVVELATFAYPQLLHTRMPGSVTVIILCRLLQFPTDGSF
PtIP-83Cf  (50) AETVKRVYVFADVVELAPGKR-----TQLPGSVTVIILCRLLQFPTGGSR
PtIP-83Da  (46) AGRVKRVYVFADVVELAPRAT-LRDQMHMPGSVTVIVLCRLLQFPIDGSQ 101                                              150
PtIP-83Aa  (98) SDTELHLTFMKLHAIQ--REENRWEITAADGMNWGVYIHAEEVQVGVLTM
PtIP-83Ca  (95) -ATTLRLPFMQLHAR-VIEQNVKSEITATDGMNWGIYIYGEKVERSPLLP
PtIP-83Cb  (96) -AAWLELPFMELHT---LIEQYRSEIKAADDAKWGTYVHAEEVQLSPLFN
PtIP-83Cc  (95) -ATTLRLPFMQLHAR-VIEQNVKSEITATDGMNWGIYIYGEKVERSPLLP
PtIP-83Cd  (95) -ATTLRLPFMQLHAR-VIEQNVKSEITATDGMNWGIYIYGEKVERSPLLP
PtIP-83Ce  (95) -ATTLRLPFMQLHAR-VIEQNVKSEITATDGMNWGIYIYGEKVERSPLLP
PtIP-83Cg  (96) -AAWLELPFMELHT---LIEQYRSEIKAADDAKWGTYVHAEEVQLSPLFN
PtIP-83Cf  (95) -AATLQLPFMKVHAT--LIERFRSEIAAADGMNWGTYIHGEEVQVSPLYP
PtIP-83Da  (95) -ATTLRLPFMQLHAR-VIEQNVKSEITATDGMNWGIYIYGEKVERSPLLP 151                                              200
PtIP-83Aa  (146) SWSSVLRVSALRSVITSGFRAVSVFEVPGSVRSTLGATLRPDHALYSTTM
PtIP-83Ca  (143) SNA-ILAVWADRCTITS--ARHNHVNAPGRIISTFTLGSGVTG---ITSM
PtIP-83Cb  (142) GWP-YLVVEAQRCIITA--AMHNTFNRPGWVRSITQFTTDQSGR--VDTT
PtIP-83Cc  (143) SNA-ILAVWADRCTITS--ARHNHVNAPGRIISTFTLGSGVTG---ITSM
PtIP-83Cd  (143) SNA-ILAVWADRCTITS--ARHNHVNAPGRIISTFTLGSGVTG---ITSM
PtIP-83Ce  (143) SNA-ILAVWADRCTITS--ARHNHVNAPGRIISTFTLGSGVTG---ITSM
PtIP-83Cg  (142) GWP-YLVVEAQRCIITA--AMHNTFNRPGWVRSVTQFTTDQSGR--VDTT
PtIP-83Cf  (142) NNS-ILGVWADRSIITS--AFHNVFDEPGRVISSTSITRAQSAPN-NTTM
PtIP-83Da  (143) SNA-ILAVWADRCTITS--ARHNHVNAPGRIISTFTLGSGVTG---ITSM
```

Fig. 5b

```
            201                                                  250
PtIP-83Aa (196) QATPNASHISAFNLRIVSPSAYRVCPLQNDTDTYLGIPADVAAVLPVDVV
PtIP-83Ca (187) HGEPSLDPWNGVSLDSASPTAFSALPRQSRN--------ISFTSIPVEVV
PtIP-83Cb (187) LLARTEFGHIDLPLETDSPTAFSVSHRQSTNL------PVEYTGIPVEVV
PtIP-83Cc (187) HGEPSLDPWNGVSLDSASPTAFSALPRQSRN--------ISFTSIPVEVV
PtIP-83Cd (187) HGEPSLDPWNGVSLDSASPTAFSALPRQSRN--------ISFTSIPVEVV
PtIP-83Ce (187) HGEPSLDPWNGVSLDSASPTAFSALPRQSRN--------ISFTSIPVEVV
PtIP-83Cg (187) LLARTEFGHIYLPLETDSPTAFSVSHRQSTNL------PVEYTGIPVEVV
PtIP-83Cf (188) SAEPGWLSGNRFLLYTVSRSAFSVLPSQSTN--------VSFTSIPVEVV
PtIP-83Da (187) HGEPSLDPWNGVSLDSASPTAFSALPRQSRN--------ISFTSIPVEVV 251                                                  300
PtIP-83Aa (246) TDPNILLGMQTTVHIAELVKACHP-SPDVVSAVGEHLNWLNKLLLPLKES
PtIP-83Ca (229) TDPSILLGMQTTVLIAELVKVCRPPSPDMMSAVAEHALWLNDVLLQVVQN
PtIP-83Cb (231) TDPNILMGMQTSVHIAELVKACYP-SPELVSAVGVHVNWLNEVLLRVVQK
PtIP-83Cc (229) TDPSILLGMQTTVLIAELVKVCRPPSPDMMSAVAEHALWLNDVLLQVVQK
PtIP-83Cd (229) TDPSILLGMQTTVLIAELVKVCRPPSPDMMSAVAEHALWLNDVLLQVVQK
PtIP-83Ce (229) TDPSILLGMQTTVLIAELVKVCRPPSPDMMSAVAEHALWLNDVLLQVVQK
PtIP-83Cg (231) TDPNILMGMQTSVHIAELVKACYP-SPELVSAVGVHVNWLNEVLLRVVQK
PtIP-83Cf (230) TDPNILLGMQTTVHIAELVKAGHP-SPDIVSAVAEHAIWLSKVLLQVVQN
PtIP-83Da (229) TDPSILLGMQTTVLIAELVKVCRPPSPDMMSAVAEHALWLNDVLLQVVQK 301                                                  350
PtIP-83Aa (295) -TQLQGSESYKECLALLGRVHAAMKMVRIGLVVPQLQYRMYGSLINQMAQ
PtIP-83Ca (279) ESQLQGTAPYNECLALLGRIECVMKIGRFVSVVPQLQYRMYGNLIKQMAQ
PtIP-83Cb (280) ESQLQGTEAYNECLALLGRIQCVMKMGPFVSVVPQLQYRMYGSLIRQMAQ
PtIP-83Cc (279) ESQMQGTAPYNECLALLGRIECVMKIGRFVSVVPQLQYRMYGNLIKQMAQ
PtIP-83Cd (279) ESQMQGTAPYNECLALLGRIECVMKIGRFVSVVPQLQYRMYGNLIKQMAQ
PtIP-83Ce (279) ESQMQGTAPYNECLALLGRIECVMKIGRFVSVVPQLQYRMYGNLIKQMAQ
PtIP-83Cg (280) ESQLQGTEAYNECLALLGRIQCVMKMGPFVSVVPQLQYRMYGSLIRQMAQ
PtIP-83Cf (279) ESHLQGTESYNECLALLGRVQSVIKMGRFGLVVPQLQYRMYGSLIKQMAQ
PtIP-83Da (279) ESQMQGTAPYNECLALLGRIECVMKIGRFVSVVPQLQYRMYGNLIKQMAQ 351                                                  400
PtIP-83Aa (344) VAQNYDREFKQFKLFIIQNQILGSYLLQQNRAFAERELQMESFHAAVISQ
PtIP-83Ca (329) VAQNYDQEFKQFKLFIVQNQILGSYLLQKNKALADRELQMESFHSAVISQ
PtIP-83Cb (330) VAQNYDQDFRQLKLFIAQNQILGSYLLQQNKAFADREVQMESFHSAVISQ
PtIP-83Cc (329) VAQNYDQEFKQFKLFIIQNQIFGSYLLQQNKAFADRELQMESFHSAVISQ
PtIP-83Cd (329) VAQNYDQEFKQFKLFIIQNQIFGSYLLQQNKAFADRELQMESFHSAVISQ
PtIP-83Ce (329) VAQNYDQEFKQFKLFIIQNQIFGSYLLQQNKAFADRELQMESFHSAVISQ
PtIP-83Cg (330) VAQNYDQDFRQLKLFIAQNQILGSYLLQQNKAFADREVQMESFHSAVISQ
PtIP-83Cf (329) VAQNYDQDFKRFRLFILQNQILGSYLLEQNKAFADRELQMESFHSAVISQ
PtIP-83Da (329) VAQNYDQEFKQFKLFIIQNQIFGSYLLQQNKAFADRELQMESFHSAVISQ
```

Fig. 5c

```
              401                                               450
PtIP-83Aa (394) RREELDNTFAKMDRLSGQMEAESSAMEQAKKEMDEGLRQFQNRQVANALF
PtIP-83Ca (379) RRQELNTAIAKMERMSLQMEEENRAMEQAQKEMEEGLREFQNRQVARAVF
PtIP-83Cb (380) RRQELDDAIAKMDRLSLQMEEEDRAMEQARKEMEEGLKQFQNEQVARAVF
PtIP-83Cc (379) RRQELNTAIAKMERMSLQMEEENRAMEQAQKEMEEGLREFQNRQVARAVF
PtIP-83Cd (379) RRQELNTAIAKMERMSLQMEEENRAMEQAQKEMEEGLREFQNRQVARAVF
PtIP-83Ce (379) RRQELNTAIAKMERMSLQMEEENRAMEQAQKEMEEGLREFQNRQVARAVF
PtIP-83Cg (380) RRQELDDALAKMDRLSLQMEEEDRAMEQARKEMEEGLKQFQNEQVARAVF
PtIP-83Cf (379) RKGELDTAFAKMDRLSLQMEEENGAMEQAQKEMDEGLRQFQNRQVARALF
PtIP-83Da (379) RRQELNTAIAKMERMSLQMEEENRAMEQAQKEMEEGLREFQNRQVARAVF 451                                               500
PtIP-83Aa (444) AVLSAVAQIGLAFLTAGATAPGAVASAGQAVSIAGQAAQGLRRVVEILEQ
PtIP-83Ca (429) AVLKAVAMIALVFVTAGATAPGAAASAGQAVSIAGQAAQALRRVVEILEG
PtIP-83Cb (430) AVLKSVAMIALAFVTAGATAPGAAASAAQAVNIAGQAAQALRRVVEILEG
PtIP-83Cc (429) AVLKAVAMIALAFVTAGATAPGAAASAGQAVSIAGQAAQALRRVVEILEG
PtIP-83Cd (429) AVLKAVAMIALAFVTAGATAPGAAASAGQAVSIAGQAAQALRRVVEILEG
PtIP-83Ce (429) AVLKAVAMIALAFVTAGATAPGAAASAGQAVSIAGQAAQALRRVVEILEG
PtIP-83Cg (430) AVLKSVAMIALAFVTAGATAPGAAASAAQAVNIAGQAAQALRRVVEILEG
PtIP-83Cf (429) AVLRAVAQIGLAFVTAGATAPGAVASAGQAVSIAGQAAQGLRRVVEILEQ
PtIP-83Da (429) AVLKAVAMIALAFVTAGATAPGAAASAGQAVSIAGQAAQALRRVVEILEG 501                                               550
PtIP-83Aa (494) LEAVMEVVAAVKDLVDSLEQVGQIVDAPVMPELPSEADWSIFVNEVEAVA
PtIP-83Ca (479) LEAVMEVVAAVKDLVDSLEQVGQIVGAPEMPDMPSEADWSIFVNEIEAVA
PtIP-83Cb (480) LEAVMEVVAAIKHLVDALDQVSQIVDAPPMPDMPSEADWSIFVNEIEAVA
PtIP-83Cc (479) LEAVMEVVAAVKDLVDSLEQVGHIVGAPEMPDMPSEADWSIFVNEIEAVA
PtIP-83Cd (479) LEAVMEVVAAVKDLVDSLEQVGHIVGAPEMPDMPSEADWSIFVNEIEAVA
PtIP-83Ce (479) LEAVMEVVAAVKDLVDSLEQVGHIVGAPEMPDMPSEADWSIFVNEIEAVA
PtIP-83Cg (480) LEAVMEVVAAIKHLVDALDQVSQIVDAPPMPDMPSEADWSIFVNEIEAVA
PtIP-83Cf (479) LEAVMEVVAAVKDLVNSLEQVGQLVQAPVMPDMPSEADWSIFVNEVEAVA
PtIP-83Da (479) LEAVMEVVAAVKDLVDSLEQVGHIVGAPEMPDMPSEADWSIFVNEIEAVA 551                                               600
PtIP-83Aa (544) EGMPTEVSEVPVWRAKCKNVAALGREMSITAVQMSELQYDIWVQGMMRDM
PtIP-83Ca (529) EGMPTEVSEVPAWKAKCKNMAALGREMSITAVQISELQYEIWVQGLMRDI
PtIP-83Cb (530) EGMPTEVSEVPAWKAKCKNVAALGREMCITAEQISQLQYDIWVQGLLRDI
PtIP-83Cc (529) EGMPTEVSEVPAWKAKCKNMAALGREMSITAVQISELQYEIWVQGLMRDI
PtIP-83Cd (529) EGMPTEVSEVPAWKAKCKNMAALGREMSITAVQISELQYEIWVQGLMRDI
PtIP-83Ce (529) EGMPTEVSEVPAWKAKCKNMAALGREMSITAVQISELQYEIWVQGLMRDI
PtIP-83Cg (530) EGMPTEVSEVPAWKAKCKNVAALGREMCITAEQISQLQYDIWVQGLLRDI
PtIP-83Cf (529) EGMPTEVSEVPAWKAKCKNVAALGREMSITAVQISELQYDIWVQGMMRDI
PtIP-83Da (529) EGMPTEVSEVPAWKAKCKNMAALGREMSITAVQISELQYEIWVQGLMRDI
```

Fig. 5d

```
                  601                                              650
PtIP-83Aa  (594)  ARSQADRLAAIQPADLTNYLEMATQMDMRTTRMLLGLLNILRIQNAALRY
PtIP-83Ca  (579)  ARSHADRLAAIQPVDLTNHLEMATHMDMRTTSMLIGLLNMLRIQNAALMY
PtIP-83Cb  (580)  AQSHADRLAAIQPANLTNYLEMAIQMDMRTTRILIGLLNIMRIQNAALMY
PtIP-83Cc  (579)  ARSHADRLAAIQPVDLTNHLEMATHMDMRTTSMLIGLLNMLRIQNAALMY
PtIP-83Cd  (579)  ARSHADRLAAIQPVDLTNHLEMATHMDMRTTSMLIGLLNMLRIQNAALMY
PtIP-83Ce  (579)  ARSHADRLAAIQPVDLTNHLEMATHMDMRTTSMLIGLLNMLRIQNAALMY
PtIP-83Cg  (580)  AQTHADRLAAIQPANLTNYLEMATQMDMRTTRILIGLLNIMRIQNAALMY
PtIP-83Cf  (579)  AQSQADRLAAIQPADLTNFLEMATQMDMRTTRMLIGLLNMLRIQNAALMY
PtIP-83Da  (579)  ARSHADRLAAIQPVDLTNHLEMATHMDMRTTSMLIGLLNMLRIQNAALMY 651                                              700
PtIP-83Aa  (644)  EYLLMPTELTTWPLGMDTVGDLLIAQENAALIGLMQLGPSSDFTSRHVVK
PtIP-83Ca  (629)  EYLLTPTELTVWPLGMDTVANLLIAQENAALVGLIQLGQSSNFTSRHVVK
PtIP-83Cb  (630)  EYLLTPTQLTAWPLRMDTVANLLITHESAALSGLAQLGPPSDFTSRHVVK
PtIP-83Cc  (629)  EYLLTPTELTVWPLGMDTVANLLIAQENAALVGLIQLGPSSNFTSRHVVK
PtIP-83Cd  (629)  EYLLTPTELTVWPLGMDTVANLLIAQENAALVGLIQLGPSSNFTSRHVVK
PtIP-83Ce  (629)  EYLLTPTELTVWPLGMDTVANLLIAQENAALVGLIQLGPSSNFTSRHVVK
PtIP-83Cg  (630)  EYLLTPTQLTAWPLRMDTVANLLITQESAALSGLAQLGPPSDFTSRHVVK
PtIP-83Cf  (629)  EYLLTPTELTAWPLGMDTVGNLLIAQENAALLGLTQLGPSSDFTSRHVVK
PtIP-83Da  (629)  EYLLTPTELTVWPLGMDTVANLLIAQENAALVGLIQLGPSSNFTSRHVVK 701                                              750
PtIP-83Aa  (694)  DIPVNLLLDGEDWEFEIPVQAGMSSFPSSWSRVRIRHLEMHFVKEASGIG
PtIP-83Ca  (679)  GIPVSLLLDGEDWEFEIPVQAGMSSFPFNWTRVRIRHLEMQFAQEASGGG
PtIP-83Cb  (680)  GIPVSLLLDGGDWEFEIPVQGGMSSFPSSWTRVRIRHLEMHFVQEASGG-
PtIP-83Cc  (679)  GIPVSLLLDGEDWEFEIPVQAGMSSFPFNWTRVRIRHLEMQFAQEASGG-
PtIP-83Cd  (679)  GIPVSLLLDGEDWEFEIPVQAGMSSFPFNWTRVRIRHLEMQFAQEASGG-
PtIP-83Ce  (679)  GIPVSLLLDGEDWEFEIPVQAGMSSFPFNWTRVRIRHLEMQFAQEASGG-
PtIP-83Cg  (680)  GIPVSLLLDGGDWEFEIPVQGGMSSFPSSWTRVRIRHLEMHFVQEASGG-
PtIP-83Cf  (679)  GIPVSLLLDGEDWEFEIPVQGGMSSFPSSWTRVRIRHLEMHFVQESMNGG
PtIP-83Da  (679)  GIPVSLLLDGEDWEFEIPVQAGMSSFPFNWTRVRIRHLEMQFAQEASGG- 751                                              800
PtIP-83Aa  (744)  -GEIIHQPTTQTGTVYILLQGSTIFHDRRRDQVLPFQAAAPLNYHYAYRL
PtIP-83Ca  (729)  GGEIIHQPSTRSGIVYILLQGSTIFHDRRRDEVMTFQAADPLNFQYAYRL
PtIP-83Cb  (729)  -GEIIHQPATQTGTIYILLQGSTVFHDRRREEVMTFQAAVPLNYHYAYRL
PtIP-83Cc  (728)  -DEIIHQPSTRSGIVYILLQGSTIFHDRRRDEVMTFQAADPLNFQYAYRL
PtIP-83Cd  (728)  -DEIIHQPSTRSGIVYILLQGSTIFHDRRRDEVMTFQAADPLNFQYAYRL
PtIP-83Ce  (728)  -DEIIHQPSTRSGIVYILLQGSTIFHDRRRDEVMTFQAADPLNFQYAYRL
PtIP-83Cg  (729)  -GEIIHQPATQTGTVYILLQGSTVFHDRRREEVMTFQAAVPLNYHYAYRL
PtIP-83Cf  (729)  -GEIIHQPATQTGTVYILLQGSTIFHDRRRDEVMTFQAAAPLNYQYAYRL
PtIP-83Da  (728)  -DEIIHQPSTRSGIVYILLQGSTIFHDRRRDEVMTFQAADPLNFQMRTAS
```

Fig. 5e

```
              801                                                850
PtIP-83Aa (793) DTGDSTLTNEPSEQFANKFMQMTPFTRWRLRLSASAKENAGLAFPTATAL
PtIP-83Ca (779) DTGEATLTNEPSEDFANTFMQMTPFTRWRLRLSASASENAELAFPTATAP
PtIP-83Cb (778) DTGEATLTNEPSEQFANTFMQMTPFTHWRLRLSASAAENKGLAFPTATAP
PtIP-83Cc (777) DTGEATLTNEPSEEFANTFMQMTPFTRWRLRLSASASENAELAFPTATAP
PtIP-83Cd (777) DTGEATLTNEPSEEFANTFMQMTPFTRWRLRLSASASENAELAFPTATAP
PtIP-83Ce (777) DTGEATLTNEPSEEFANTFMQMTPFTRWRLRLSASASENAELAFPTATAP
PtIP-83Cg (778) DTGEATLTNEPSEQFANTFMQMTPFTHWRLRLSASAAENEGLAFPTATAP
PtIP-83Cf (778) DTGETTLTNQPSEHFANTFMQMTPFTRWRLRLSASAPENAGLAFPTATAL
PtIP-83Da (777) TLAKPL--------------------------------------------

851              878
PtIP-83Aa (843) DSTTQIVITFHVTAIRQIDWRHDEE---
PtIP-83Ca (829) DSTTEVVITFHVTAIRQVDWRQEEE---
PtIP-83Cb (828) DSTTEIAITFHVTAIRQIDWRQEEE---
PtIP-83Cc (827) DSTTEVVITFHVTAIRQVDWRQEEE---
PtIP-83Cd (827) DSTTEVVITFHVTAIRQVDWRQEEE---
PtIP-83Ce (827) DSTTEVVITFHVTAIRQVDWRQEEKEEE
PtIP-83Cg (828) DSTTEIAITFHVMAIRQIDWRQEEE---
PtIP-83Cf (828) DSTTQIVITFHVTAIRQIDWRHEEE---
PtIP-83Da (783) ----------------------------
```

INSECTICIDAL PROTEINS FROM PLANTS AND METHODS FOR THEIR USE

CROSS REFERENCE

This application is a 371 (National Stage) of PCT/US15/14824 filed Feb. 6, 2015, which claims the benefit of U.S. Provisional Application No. 61/937,295 filed Feb. 7, 2014, and U.S. Provisional Application No. 62/051,720 filed Sep. 17, 2014, which are incorporated herein by reference in their entirety.

REFERENCE TO SEQUENCE LISTING SUBMITTED ELECTRONICALLY

The official copy of the sequence listing is submitted electronically via EFS-Web as an ASCII formatted sequence listing with a file named "6054PCT_Sequence_Listing" created on Jan. 26, 2015, and having a size of 3,705 kilobytes and is filed concurrently with the specification. The sequence listing contained in this ASCII formatted document is part of the specification and is herein incorporated by reference in its entirety.

FIELD

This disclosure relates to the field of molecular biology. Provided are novel genes that encode pesticidal proteins. These pesticidal proteins and the nucleic acid sequences that encode them are useful in preparing pesticidal formulations and in the production of transgenic pest-resistant plants.

BACKGROUND

Biological control of insect pests of agricultural significance using a microbial agent, such as fungi, bacteria or another species of insect affords an environmentally friendly and commercially attractive alternative to synthetic chemical pesticides. Generally speaking, the use of biopesticides presents a lower risk of pollution and environmental hazards and biopesticides provide greater target specificity than is characteristic of traditional broad-spectrum chemical insecticides. In addition, biopesticides often cost less to produce and thus improve economic yield for a wide variety of crops.

Certain species of microorganisms of the genus *Bacillus* are known to possess pesticidal activity against a range of insect pests including Lepidoptera, Diptera, Coleoptera, Hemiptera and others. *Bacillus thuringiensis* (Bt) and *Bacillus popilliae* are among the most successful biocontrol agents discovered to date. Insect pathogenicity has also been attributed to strains of *B. larvae, B. lentimorbus, B. sphaericus* and *B. cereus*. Microbial insecticides, particularly those obtained from *Bacillus* strains, have played an important role in agriculture as alternatives to chemical pest control.

Crop plants have been developed with enhanced insect resistance by genetically engineering crop plants to produce pesticidal proteins from *Bacillus*. For example, corn and cotton plants have been genetically engineered to produce pesticidal proteins isolated from strains of Bt. These genetically engineered crops are now widely used in agriculture and have provided the farmer with an environmentally friendly alternative to traditional insect-control methods. While they have proven to be very successful commercially, these genetically engineered, insect-resistant crop plants provide resistance to only a narrow range of the economically important insect pests. In some cases, insects can develop resistance to different insecticidal compounds, which raises the need to identify alternative biological control agents for pest control.

Accordingly, there remains a need for new pesticidal proteins with different ranges of insecticidal activity against insect pests, e.g., insecticidal proteins which are active against a variety of insects in the order Lepidoptera and/or the order Coleoptera including but not limited to insect pests that have developed resistance to existing insecticides.

SUMMARY

Compositions and methods for conferring pesticidal activity to bacteria, plants, plant cells, tissues and seeds are provided. Compositions include nucleic acid molecules encoding sequences for pesticidal and insecticidal polypeptides, vectors comprising those nucleic acid molecules, and host cells comprising the vectors. Compositions also include the pesticidal polypeptide sequences and antibodies to those polypeptides. The nucleic acid sequences can be used in DNA constructs or expression cassettes for transformation and expression in organisms, including microorganisms and plants. The nucleotide or amino acid sequences may be synthetic sequences that have been designed for expression in an organism including, but not limited to, a microorganism or a plant. Compositions also comprise transformed bacteria, plants, plant cells, tissues and seeds.

In particular, isolated or recombinant nucleic acid molecules are provided encoding *Pteridophyta* Insecticidal Protein-83 (PtIP-83) polypeptides including amino acid substitutions, deletions, insertions, fragments thereof. Additionally, amino acid sequences corresponding to the PtIP-83 polypeptides are encompassed. Provided are isolated or recombinant nucleic acid molecules capable of encoding PtIP-83 polypeptides of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, and SEQ ID NO: 769, as well as amino acid substitutions, deletions, insertions, fragments thereof, and combinations thereof. Nucleic acid sequences that are complementary to a nucleic acid sequence of the embodiments or that hybridize to a sequence of the embodiments are also encompassed. Also provided are isolated or recombinant PtIP-83 polypeptides of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, and SEQ ID NO: 769, as well as amino acid substitutions, deletions, insertions, fragments thereof and combinations thereof.

Methods are provided for producing the polypeptides and for using those polypeptides for controlling or killing a Lepidopteran, Coleopteran, nematode, fungi, and/or Dipteran pests. The transgenic plants of the embodiments express one or more of the pesticidal sequences disclosed herein. In various embodiments, the transgenic plant further comprises one or more additional genes for insect resistance, for example, one or more additional genes for controlling Coleopteran, Lepidopteran, Hemipteran or nematode pests. It will be understood by one of skill in the art that the transgenic plant may comprise any gene imparting an agronomic trait of interest.

Methods for detecting the nucleic acids and polypeptides of the embodiments in a sample are also included. A kit for detecting the presence of a PtIP-83 polypeptide or detecting the presence of a polynucleotide encoding a PtIP-83 polypeptide in a sample is provided. The kit may be provided along with all reagents and control samples necessary for carrying out a method for detecting the intended agent, as well as instructions for use.

The compositions and methods of the embodiments are useful for the production of organisms with enhanced pest resistance or tolerance. These organisms and compositions comprising the organisms are desirable for agricultural purposes. The compositions of the embodiments are also useful for generating altered or improved proteins that have pesticidal activity or for detecting the presence of PtIP-83 polypeptides.

BRIEF DESCRIPTION OF THE FIGURES

FIG. 2a-2j shows an alignment of the amino acid sequences of PtIP-83Aa (SEQ ID NO: 1), PtIP-83Ca (SEQ ID NO: 5), PtIP-83Cb (SEQ ID NO: 7), PtIP-83Cc (SEQ ID NO: 9), PtIP-83Cd (SEQ ID NO: 11), PtIP-83Ce (SEQ ID NO: 13), PtIP-83Cf (SEQ ID NO: 15), and PtIP-83Fa (SEQ ID NO: 3); an alignment of the secondary structure prediction, by the PSIPRED, top ranked secondary structure prediction method, for PtIP-83Aa (SEQ ID NO: 1) and PtIP-83Fa (SEQ ID NO: 3); and the locations of the amino acid sequence MOTIFs, as predicted by MEME motif analysis, relative to PtIP-83Aa (SEQ ID NO: 1). A "H" indicates a predicted helical structure, an "E" indicates a PtIP-beta strand structure, and a "C" indicates a predicted coil structure.

FIG. 3a-3b shows a sequence alignment between PtIP-83Aa (SEQ ID NO: 1) and PtIP-50Aa (SEQ ID NO: 34). The crossover points in the PtIP-83 Aa/PtIP-50Aa chimeras indicated in Table 13 are indicated by an arrow (↑) above the amino acid.

FIG. 4a-4c shows an amino acid sequence alignment of PtIP-83Aa (SEQ ID NO: 1), PtIP-83Fa (SEQ ID NO: 3), PtIP-50Aa (SEQ ID NO: 34), PtIP-50Ba (SEQ ID NO: 35), and PtIP-50Bb (SEQ ID NO: 36). The conserved sequence motifs identified are indicated and the amino acid sequence of the motifs in PtIP-83Aa (SEQ ID NO: 1) are underlined.

FIG. 5a-5e shows an amino acid sequence alignment of PtIP-83Aa (SEQ ID NO: 1), PtIP-83Ca (SEQ ID NO: 5), PtIP-83Cb (SEQ ID NO: 7), PtIP-83Cc (SEQ ID NO: 9), PtIP-83Cd (SEQ ID NO: 11), PtIP-83Ce (SEQ ID NO: 13), PtIP-83Cf (SEQ ID NO: 15), PtIP-83Cg (SEQ ID NO: 17), and PtIP-83 Da (SEQ ID NO: 19). The sequence diversity is highlighted.

DETAILED DESCRIPTION

Figure 1:
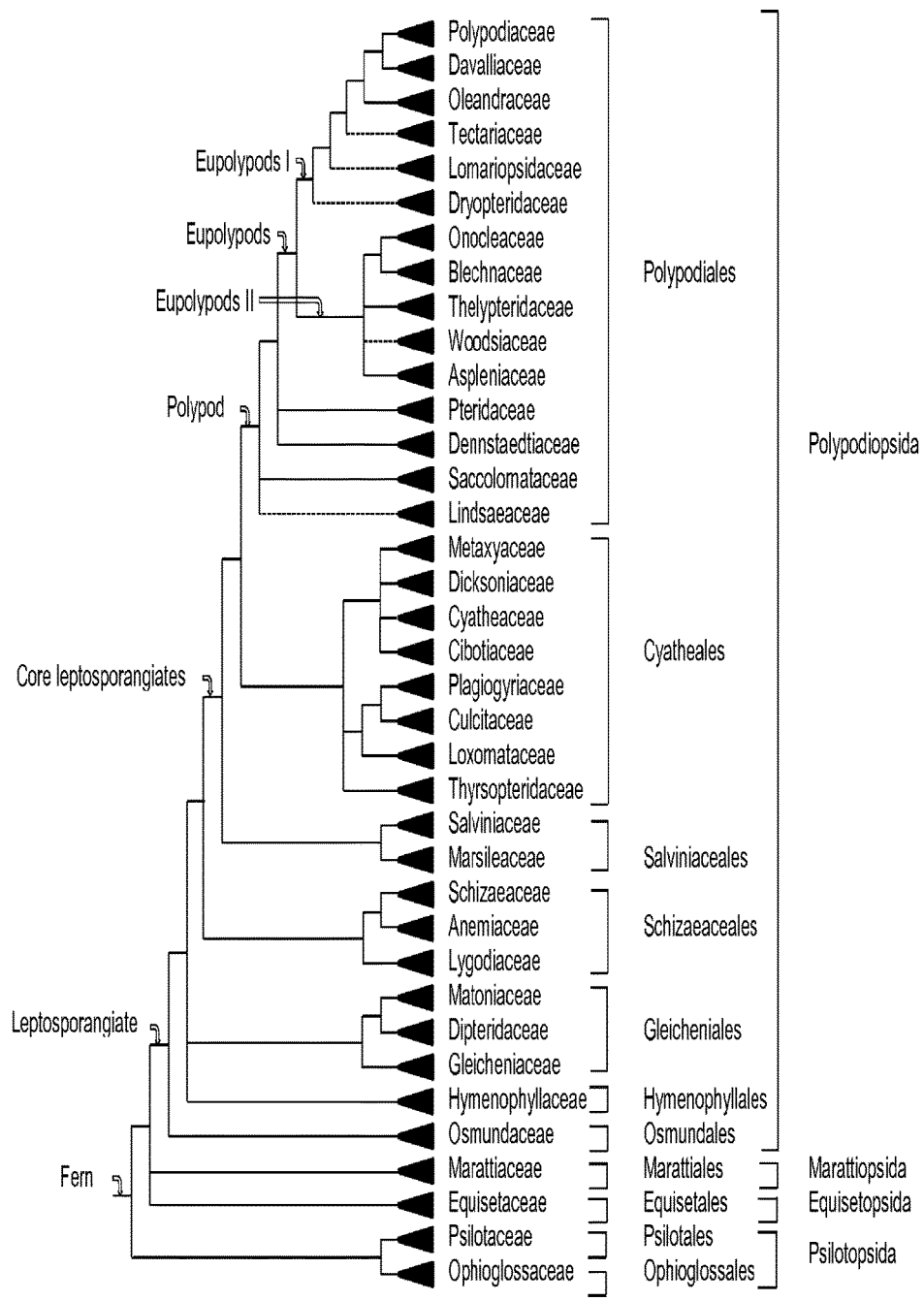
FIG. 1 the phylogeny of ferns based on the classification for extant ferns by A. R. Smith et al, *TAXON*, 55:705-731 (2006).

It is to be understood that this disclosure is not limited to the particular methodology, protocols, cell lines, genera, and reagents described, as such may vary. It is also to be understood that the terminology used herein is for the purpose of describing particular embodiments only, and is not intended to limit the scope of the present disclosure.

As used herein the singular forms "a", "and", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this disclosure belongs unless clearly indicated otherwise.

The present disclosure is drawn to compositions and methods for controlling pests. The methods involve transforming organisms with nucleic acid sequences encoding PtIP-83 polypeptides. In particular, the nucleic acid sequences of the embodiments are useful for preparing plants and microorganisms that possess pesticidal activity. Thus, transformed bacteria, plants, plant cells, plant tissues and seeds are provided. The compositions are pesticidal nucleic acids and proteins of bacterial species. The nucleic acid sequences find use in the construction of expression vectors for subsequent transformation into organisms of interest, as probes for the isolation of other homologous (or partially homologous) genes, and for the generation of altered PtIP-83 polypeptides by methods known in the art, such as site directed mutagenesis, domain swapping or DNA shuffling. The PtIP-83 find use in controlling or killing Lepidopteran, Coleopteran, Dipteran, fungal, Hemipteran and nematode pest populations and for producing compositions with pesticidal activity. Insect pests of interest include, but are not limited to, Lepidoptera species including but not limited to: Corn Earworm, (CEW) (*Helicoverpa zea*), European Corn Borer (ECB) (*Ostrinia nubilalis*), diamond-back moth, e.g., *Helicoverpa zea* Boddie; soybean looper, e.g., *Pseudoplusia includens* Walker; and velvet bean caterpillar e.g., *Anticarsia gemmatalis* Hübner and Coleoptera species including but not limited to Western corn rootworm (*Diabrotica virgifera*)—WCRW, Southern corn rootworm (*Diabrotica undecimpunctata howardi*)—SCRW, and Northern corn rootworm (*Diabrotica barberi*)—NCRW.

By "pesticidal toxin" or "pesticidal protein" is used herein to refer to a toxin that has toxic activity against one or more pests, including, but not limited to, members of the Lepidoptera, Diptera, Hemiptera and Coleoptera orders or the Nematoda phylum or a protein that has homology to such a protein. Pesticidal proteins have been purified from organisms including, for example, *Bacillus* sp., *Pseudomonas* sp., *Photorhabdus* sp., *Xenorhabdus* sp., *Clostridium bifermentans* and *Paenibacillus popilliae*. Pesticidal proteins include but are not limited to: insecticidal proteins from *Pseudomonas* sp. such as PSEEN3174 (Monalysin; (2011) *PLoS Pathogens* 7:1-13); from *Pseudomonas protegens* strain CHA0 and Pf-5 (previously *fluorescens*) (Pechy-Tarr, (2008) *Environmental Microbiology* 10:2368-2386; GenBank Accession No. EU400157); from *Pseudomonas Taiwanensis* (Liu, et al., (2010) *J. Agric. Food Chem.,* 58:12343-12349) and from *Pseudomonas pseudoalcligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxicology Journal,* 3:101-118 and Morgan, et al., (2001) *Applied and Envir. Micro.* 67:2062-2069); U.S. Pat. No. 6,048,838, and U.S. Pat. No. 6,379,946; a PIP-1 polypeptide of US Patent Publication US20140007292; an AfIP-1A and/or AfIP-1B polypeptide of US Patent Publication US20140033361; a PHI-4 polypeptide of US patent Publication US20140274885 and PCT Patent Publication WO2014/150914; a PIP-47 polypeptide of PCT Serial Number PCT/US14/51063, a PIP-72 polypeptide of PCT Serial Number PCT/US14/55128, and δ-endotoxins including, but not limited to, the Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry 28, Cry 29, Cry 30, Cry31, Cry32, Cry33, Cry34, Cry35, Cry36, Cry37, Cry38, Cry39, Cry40, Cry41, Cry42, Cry43, Cry44, Cry45, Cry 46, Cry47, Cry49, Cry50, Cry51, Cry52, Cry53, Cry 54, Cry55, Cry56, Cry57, Cry58, Cry59, Cry60, Cry61, Cry62, Cry63, Cry64, Cry65, Cry66, Cry67, Cry68, Cry69, Cry70, Cry71, and Cry 72 classes of δ-endotoxin genes and the *B. thuringiensis* cytolytic cyt1 and cyt2 genes. Members of these classes of *B. thuringiensis insecticidal proteins include, but are not limited to, Cry*1Aa1 (Accession # AAA22353); Cry1Aa2 (Accession # Accession # AAA22552); Cry1Aa3 (Accession # BAA00257); Cry1Aa4 (Accession # CAA31886); Cry1Aa5 (Accession # BAA04468); Cry1Aa6 (Accession #AAA86265); Cry1Aa7 (Accession # AAD46139); Cry1Aa8 (Accession # I26149); Cry1Aa9 (Accession # BAA77213); Cry1Aa10 (Accession # AAD55382); Cry1Aa11 (Accession #CAA70856); Cry1Aa12 (Accession # AAP80146); Cry1Aa13 (Accession # AAM44305); Cry1Aa14 (Accession # AAP40639); Cry1Aa15 (Accession # AAY66993); Cry1Aa16 (Accession # HQ439776); Cry1Aa17 (Accession # HQ439788); Cry1Aa18 (Accession #HQ439790); Cry1Aa19 (Accession # HQ685121); Cry1Aa20 (Accession # JF340156); Cry1Aa21 (Accession # JN651496); Cry1Aa22 (Accession # KC158223); Cry1Ab1 (Accession # AAA22330); Cry1Ab2 (Accession # AAA22613); Cry1Ab3 (Accession #AAA22561); Cry1Ab4 (Accession # BAA00071); Cry1Ab5 (Accession # CAA28405); Cry1Ab6 (Accession # AAA22420); Cry1Ab7 (Accession # CAA31620); Cry1Ab8 (Accession #AAA22551); Cry1Ab9 (Accession # CAA38701); Cry1Ab10 (Accession # A29125); Cry1Ab11 (Accession # I12419); Cry1Ab12 (Accession # AAC64003); Cry1Ab13 (Accession #AAN76494); Cry1Ab14 (Accession # AAG16877); Cry1Ab15 (Accession # AAO13302); Cry1Ab16 (Accession # AAK55546); Cry1Ab17 (Accession # AAT46415); Cry1Ab18 (Accession # AAQ88259); Cry1Ab19 (Accession # AAW31761); Cry1Ab20 (Accession #ABB72460); Cry1Ab21 (Accession # ABS18384); Cry1Ab22 (Accession # ABW87320); Cry1Ab23 (Accession # HQ439777); Cry1Ab24 (Accession # HQ439778); Cry1Ab25 (Accession # HQ685122); Cry1Ab26 (Accession # HQ847729); Cry1Ab27 (Accession #JN135249); Cry1Ab28 (Accession # JN135250); Cry1Ab29 (Accession # JN135251); Cry1Ab30 (Accession # JN135252); Cry1Ab31 (Accession # JN135253); Cry1Ab32 (Accession # JN135254); Cry1Ab33 (Accession # AAS93798); Cry1Ab34 (Accession #KC156668); Cry1Ab-like (Accession # AAK14336); Cry1Ab-like (Accession # AAK14337); Cry1Ab-like (Accession # AAK14338); Cry1Ab-like (Accession # ABG88858); Cry1Ac1 (Accession # AAA22331); Cry1Ac2 (Accession # AAA22338); Cry1Ac3 (Accession #CAA38098); Cry1Ac4 (Accession # AAA73077); Cry1Ac5 (Accession # AAA22339); Cry1Ac6 (Accession # AAA86266); Cry1Ac7 (Accession # AAB46989); Cry1Ac8 (Accession #AAC44841); Cry1Ac9 (Accession # AAB49768); Cry1Ac10 (Accession # CAA05505); Cry1Ac11 (Accession # CAA10270); Cry1Ac12 (Accession # I12418); Cry1Ac13 (Accession # AAD38701); Cry1Ac14 (Accession # AAQ06607); Cry1Ac15 (Accession # AAN07788); Cry1Ac16 (Accession # AAU87037); Cry1Ac17 (Accession # AAX18704); Cry1Ac18 (Accession # AAY88347); Cry1Ac19 (Accession # ABD37053); Cry1Ac20 (Accession #ABB89046); Cry1Ac21 (Accession # AAY66992); Cry1Ac22 (Accession # ABZ01836); Cry1Ac23 (Accession # CAQ30431); Cry1Ac24 (Accession # ABL01535); Cry1Ac25 (Accession # FJ513324); Cry1Ac26 (Accession # FJ617446); Cry1Ac27 (Accession #FJ617447); Cry1Ac28 (Accession # ACM90319); Cry1Ac29 (Accession # DQ438941); Cry1Ac30 (Accession # GQ227507); Cry1Ac31 (Accession # GU446674); Cry1Ac32 (Accession # HM061081); Cry1Ac33 (Accession # GQ866913); Cry1Ac34 (Accession #HQ230364); Cry1Ac35 (Accession # JF340157); Cry1Ac36 (Accession # JN387137); Cry1Ac37 (Accession # JQ317685); Cry1Ad1 (Accession # AAA22340); Cry1Ad2 (Accession # CAA01880); Cry1Ae1 (Accession # AAA22410); Cry1Af1 (Accession # AAB82749); Cry1Ag1 (Accession # AAD46137); Cry1Ah1 (Accession # AAQ14326); Cry1Ah2 (Accession # ABB76664); Cry1Ah3 (Accession # HQ439779); Cry1Ai1 (Accession # AA039719); Cry1Ai2 (Accession # HQ439780); Cry1A-like (Accession # AAK14339); Cry1Ba1 (Accession # CAA29898); Cry1Ba2 (Accession # CAA65003); Cry1Ba3 (Accession # AAK63251); Cry1Ba4 (Accession # AAK51084); Cry1Ba5 (Accession # AB020894); Cry1Ba6 (Accession # ABL60921); Cry1Ba7 (Accession # HQ439781); Cry1Bb1 (Accession # AAA22344); Cry1Bb2 (Accession # HQ439782); Cry1Bc1 (Accession # CAA86568); Cry1Bd1 (Accession # AAD10292); Cry1Bd2 (Accession # AAM93496); Cry1Be1 (Accession # AAC32850); Cry1Be2 (Accession # AAQ52387); Cry1Be3 (Accession # ACV96720); Cry1Be4 (Accession # HM070026); Cry1Bf1 (Accession # CAC50778); Cry1Bf2 (Accession # AAQ52380); Cry1Bg1 (Accession # AA039720); Cry1Bh1 (Accession # HQ589331); Cry1Bi1 (Accession # KC156700); Cry1Ca1 (Accession # CAA30396); Cry1Ca2 (Accession # CAA31951); Cry1Ca3 (Accession # AAA22343); Cry1Ca4 (Accession # CAA01886); Cry1Ca5 (Accession # CAA65457); Cry1Ca6 [1] (Accession # AAF37224); Cry1Ca7 (Accession # AAG50438); Cry1Ca8 (Accession # AAM00264); Cry1Ca9 (Accession # AAL79362); Cry1Ca10 (Accession # AAN16462); Cry1Ca11 (Accession # AAX53094); Cry1Ca12 (Accession #HM070027); Cry1Ca13 (Accession # HQ412621); Cry1Ca14 (Accession # JN651493); Cry1Cb1 (Accession # M97880); Cry1Cb2 (Accession # AAG35409); Cry1Cb3 (Accession #ACD50894); Cry1Cb-like (Accession # AAX63901); Cry1Da1 (Accession # CAA38099); Cry1Da2 (Accession # I76415); Cry1Da3 (Accession # HQ439784); Cry1Db1 (Accession #CAA80234); Cry1Db2 (Accession # AAK48937); Cry1Dc1 (Accession # ABK35074); Cry1Ea1 (Accession # CAA37933); Cry1Ea2 (Accession # CAA39609); Cry1Ea3 (Accession # AAA22345); Cry1Ea4 (Accession # AAD04732); Cry1Ea5 (Accession # A15535); Cry1Ea6 (Accession # AAL50330); Cry1Ea7 (Accession # AAW72936); Cry1Ea8 (Accession #ABX11258); Cry1Ea9 (Accession # HQ439785); Cry1Ea10 (Accession # ADR00398); Cry1Ea11 (Accession # JQ652456); Cry1Eb1 (Accession # AAA22346); Cry1Fa1 (Accession # AAA22348); Cry1Fa2 (Accession # AAA22347); Cry1Fa3 (Accession # HM070028); Cry1Fa4 (Accession # HM439638); Cry1Fb1 (Accession # CAA80235); Cry1Fb2 (Accession # BAA25298); Cry1Fb3 (Accession # AAF21767); Cry1Fb4 (Accession # AAC10641); Cry1Fb5 (Accession # AAO13295); Cry1Fb6 (Accession # ACD50892); Cry1Fb7 (Accession # ACD50893); Cry1Ga1

(Accession # CAA80233); Cry1Ga2 (Accession # CAA70506); Cry1Gb1 (Accession # AAD10291); Cry1Gb2 (Accession # AA013756); Cry1Gc1 (Accession # AAQ52381); Cry1Ha1 (Accession # CAA80236); Cry1Hb1 (Accession # AAA79694); Cry1Hb2 (Accession # HQ439786); Cry1H-like (Accession # AAF01213); Cry1Ia1 (Accession # CAA44633); Cry1Ia2 (Accession # AAA22354); Cry1Ia3 (Accession # AAC36999); Cry1Ia4 (Accession # AAB00958); Cry1Ia5 (Accession # CAA70124); Cry1Ia6 (Accession #AAC26910); Cry1Ia7 (Accession # AAM73516); Cry1Ia8 (Accession # AAK66742); Cry1Ia9 (Accession # AAQ08616); Cry1Ia10 (Accession # AAP86782); Cry1Ia11 (Accession #CAC85964); Cry1Ia12 (Accession # AAV53390); Cry1Ia13 (Accession # ABF83202); Cry1Ia14 (Accession # ACG63871); Cry1Ia15 (Accession # FJ617445); Cry1Ia16 (Accession # FJ617448); Cry1Ia17 (Accession # GU989199); Cry1Ia18 (Accession #ADK23801); Cry1Ia19 (Accession # HQ439787); Cry1Ia20 (Accession # JQ228426); Cry1Ia21 (Accession # JQ228424); Cry1Ia22 (Accession # JQ228427); Cry1Ia23 (Accession # JQ228428); Cry1Ia24 (Accession # JQ228429); Cry1Ia25 (Accession # JQ228430); Cry1Ia26 (Accession # JQ228431); Cry1Ia27 (Accession # JQ228432); Cry1Ia28 (Accession # JQ228433); Cry1Ia29 (Accession # JQ228434); Cry1Ia30 (Accession # JQ317686); Cry1Ia31 (Accession # JX944038); Cry1Ia32 (Accession # JX944039); Cry1Ia33 (Accession # JX944040); Cry1Ib1 (Accession # AAA82114); Cry1Ib2 (Accession # ABW88019); Cry1Ib3 (Accession #ACD75515); Cry1Ib4 (Accession # HM051227); Cry1Ib5 (Accession # HM070028); Cry1Ib6 (Accession # ADK38579); Cry1Ib7 (Accession # JN571740); Cry1Ib8 (Accession #JN675714); Cry1Ib9 (Accession # JN675715); Cry1Ib10 (Accession # JN675716); Cry1Ib11 (Accession # JQ228423); Cry1Ic1 (Accession # AAC62933); Cry1Ic2 (Accession #AAE71691); Cry1Id1 (Accession # AAD44366); Cry1Id2 (Accession # JQ228422); Cry1Ie1 (Accession # AAG43526); Cry1Ie2 (Accession # HM439636); Cry1Ie3 (Accession #KC156647); Cry1Ie4 (Accession # KC156681); Cry1If1 (Accession # AAQ52382); Cry1Ig1 (Accession # KC156701); Cry1I-like (Accession # AAC31094); Cry1I-like (Accession #ABG88859); Cry1Ja1 (Accession # AAA22341); Cry1Ja2 (Accession # HM070030); Cry1Ja3 (Accession # JQ228425); Cry1Jb1 (Accession # AAA98959); Cry1Jc1 (Accession #AAC31092); Cry1Jc2 (Accession # AAQ52372); Cry1Jd1 (Accession # CAC50779); Cry1Ka1 (Accession # AAB00376); Cry1Ka2 (Accession # HQ439783); Cry1La1 (Accession #AAS60191); Cry1La2 (Accession # HM070031); Cry1Ma1 (Accession # FJ884067); Cry1Ma2 (Accession # KC156659); Cry1Na1 (Accession # KC156648); Cry1Nb1 (Accession #KC156678); Cry1-like (Accession # AAC31091); Cry2Aa1 (Accession # AAA22335); Cry2Aa2 (Accession # AAA83516); Cry2Aa3 (Accession # D86064); Cry2Aa4 (Accession #AAC04867); Cry2Aa5 (Accession # CAA10671); Cry2Aa6 (Accession # CAA10672); Cry2Aa7 (Accession # CAA10670); Cry2Aa8 (Accession # AAO13734); Cry2Aa9 (Accession # AA013750); Cry2Aa10 (Accession # AAQ04263); Cry2Aa11 (Accession # AAQ52384); Cry2Aa12 (Accession # AB183671); Cry2Aa13 (Accession # ABL01536); Cry2Aa14 (Accession # ACF04939); Cry2Aa15 (Accession # JN426947); Cry2Ab1 (Accession #AAA22342); Cry2Ab2 (Accession # CAA39075); Cry2Ab3 (Accession # AAG36762); Cry2Ab4 (Accession # AAO13296); Cry2Ab5 (Accession # AAQ04609); Cry2Ab6 (Accession # AAP59457); Cry2Ab7 (Accession # AAZ66347); Cry2Ab8 (Accession # ABC95996); Cry2Ab9 (Accession # ABC74968); Cry2Ab10 (Accession # EF157306); Cry2Ab11 (Accession # CAM84575); Cry2Ab12 (Accession # ABM21764); Cry2Ab13 (Accession #ACG76120); Cry2Ab14 (Accession #ACG76121); Cry2Ab15 (Accession # HM037126); Cry2Ab16 (Accession # GQ866914); Cry2Ab17 (Accession #HQ439789); Cry2Ab18 (Accession # JN135255); Cry2Ab19 (Accession # JN135256); Cry2Ab20 (Accession #JN135257); Cry2Ab21 (Accession # JN135258); Cry2Ab22 (Accession # JN135259); Cry2Ab23 (Accession # JN135260); Cry2Ab24 (Accession # JN135261); Cry2Ab25 (Accession # JN415485); Cry2Ab26 (Accession # JN426946); Cry2Ab27 (Accession #JN415764); Cry2Ab28 (Accession # JN651494); Cry2Ac1 (Accession # CAA40536); Cry2Ac2 (Accession # AAG35410); Cry2Ac3 (Accession # AAQ52385); Cry2Ac4 (Accession #ABC95997); Cry2Ac5 (Accession # ABC74969); Cry2Ac6 (Accession # ABC74793); Cry2Ac7 (Accession # CAL18690); Cry2Ac8 (Accession # CAM09325); Cry2Ac9 (Accession #CAM09326); Cry2Ac10 (Accession # ABN15104); Cry2Ac11 (Accession # CAM83895); Cry2Ac12 (Accession # CAM83896); Cry2Ad1 (Accession # AAF09583); Cry2Ad2 (Accession # ABC86927); Cry2Ad3 (Accession # CAK29504); Cry2Ad4 (Accession #CAM32331); Cry2Ad5 (Accession # CA078739); Cry2Ae1 (Accession # AAQ52362); Cry2Af1 (Accession # AB030519); Cry2Af2 (Accession # GQ866915); Cry2Ag1 (Accession #ACH91610); Cry2Ah1 (Accession # EU939453); Cry2Ah2 (Accession # ACL80665); Cry2Ah3 (Accession # GU073380); Cry2Ah4 (Accession # KC156702); Cry2Ai1 (Accession #FJ788388); Cry2Aj (Accession #); Cry2Ak1 (Accession # KC156660); Cry2Ba1 (Accession # KC156658); Cry3Aa1 (Accession # AAA22336); Cry3Aa2 (Accession # AAA22541); Cry3Aa3 (Accession # CAA68482); Cry3Aa4 (Accession # AAA22542); Cry3Aa5 (Accession # AAA50255); Cry3Aa6 (Accession # AAC43266); Cry3Aa7 (Accession # CAB41411); Cry3Aa8 (Accession # AAS79487); Cry3Aa9 (Accession # AAW05659); Cry3Aa10 (Accession # AAU29411); Cry3Aa11 (Accession # AAW82872); Cry3Aa12 (Accession #ABY49136); Cry3Ba1 (Accession # CAA34983); Cry3Ba2 (Accession # CAA00645); Cry3Ba3 (Accession # JQ397327); Cry3Bb1 (Accession # AAA22334); Cry3Bb2 (Accession # AAA74198); Cry3Bb3 (Accession # I15475); Cry3Ca1 (Accession # CAA42469); Cry4Aa1 (Accession # CAA68485); Cry4Aa2 (Accession # BAA00179); Cry4Aa3 (Accession #CAD30148); Cry4Aa4 (Accession # AFB18317); Cry4A-like (Accession # AAY96321); Cry4Ba1 (Accession # CAA30312); Cry4Ba2 (Accession # CAA30114); Cry4Ba3 (Accession # AAA22337); Cry4Ba4 (Accession # BAA00178); Cry4Ba5 (Accession # CAD30095); Cry4Ba-like (Accession # ABC47686); Cry4Ca1 (Accession # EU646202); Cry4Cb1 (Accession # FJ403208); Cry4Cb2 (Accession # FJ597622); Cry4Cc1 (Accession #FJ403207); Cry5Aa1 (Accession # AAA67694); Cry5Ab1 (Accession # AAA67693); Cry5Ac1 (Accession # I34543); Cry5Ad1 (Accession # ABQ82087); Cry5Ba1 (Accession #AAA68598); Cry5Ba2 (Accession # ABW88931); Cry5Ba3 (Accession # AFJ04417); Cry5Ca1 (Accession # HM461869); Cry5Ca2 (Accession # ZP_04123426); Cry5Da1 (Accession #HM461870); Cry5Da2 (Accession # ZP_04123980); Cry5Ea1 (Accession # HM485580); Cry5Ea2 (Accession # ZP_04124038); Cry6Aa1 (Accession # AAA22357); Cry6Aa2 (Accession # AAM46849); Cry6Aa3 (Accession # ABH03377); Cry6Ba1 (Accession #AAA22358); Cry7Aa1 (Accession #

AAA22351); Cry7Ab1 (Accession # AAA21120); Cry7Ab2 (Accession # AAA21121); Cry7Ab3 (Accession # ABX24522); Cry7Ab4 (Accession #EU380678); Cry7Ab5 (Accession # ABX79555); Cry7Ab6 (Accession # AC144005); Cry7Ab7 (Accession # ADB89216); Cry7Ab8 (Accession # GU145299); Cry7Ab9 (Accession #ADD92572); Cry7Ba1 (Accession # ABB70817); Cry7Bb1 (Accession # KC156653); Cry7Ca1 (Accession # ABR67863); Cry7Cb1 (Accession # KC156698); Cry7Da1 (Accession #ACQ99547); Cry7Da2 (Accession # HM572236); Cry7Da3 (Accession # KC156679); Cry7Ea1 (Accession # HM035086); Cry7Ea2 (Accession # HM132124); Cry7Ea3 (Accession # EEM19403); Cry7Fa1 (Accession # HM035088); Cry7Fa2 (Accession # EEM19090); Cry7Fb1 (Accession # HM572235); Cry7Fb2 (Accession # KC156682); Cry7Ga1 (Accession # HM572237); Cry7Ga2 (Accession # KC156669); Cry7Gb1 (Accession # KC156650); Cry7Gc1 (Accession # KC156654); Cry7Gd1 (Accession # KC156697); Cry7Ha1 (Accession # KC156651); Cry7Ia1 (Accession # KC156665); Cry7Ja1 (Accession # KC156671); Cry7Ka1 (Accession # KC156680); Cry7Kb1 (Accession # BAM99306); Cry7La1 (Accession #BAM99307); Cry8Aa1 (Accession # AAA21117); Cry8Ab1 (Accession # EU044830); Cry8Ac1 (Accession # KC156662); Cry8Ad1 (Accession # KC156684); Cry8Ba1 (Accession #AAA21118); Cry8Bb1 (Accession # CAD57542); Cry8Bc1 (Accession # CAD57543); Cry8Ca1 (Accession # AAA21119); Cry8Ca2 (Accession # AAR98783); Cry8Ca3 (Accession # EU625349); Cry8Ca4 (Accession # ADB54826); Cry8Da1 (Accession # BAC07226); Cry8Da2 (Accession # BD133574); Cry8Da3 (Accession # BD133575); Cry8Db1 (Accession # BAF93483); Cry8Ea1 (Accession # AAQ73470); Cry8Ea2 (Accession # EU047597); Cry8Ea3 (Accession # KC855216); Cry8Fa1 (Accession # AAT48690); Cry8Fa2 (Accession #HQ174208); Cry8Fa3 (Accession # AFH78109); Cry8Ga1 (Accession # AAT46073); Cry8Ga2 (Accession # ABC42043); Cry8Ga3 (Accession # FJ198072); Cry8Ha1 (Accession # AAW81032); Cry8Ia1 (Accession # EU381044); Cry8Ia2 (Accession # GU073381); Cry8Ia3 (Accession # HM044664); Cry8Ia4 (Accession # KC156674); Cry8Ib1 (Accession #GU325772); Cry8Ib2 (Accession # KC156677); Cry8Ja1 (Accession # EU625348); Cry8Ka1 (Accession # FJ422558); Cry8Ka2 (Accession # ACN87262); Cry8Kb1 (Accession #HM123758); Cry8Kb2 (Accession # KC156675); Cry8La1 (Accession # GU325771); Cry8Ma1 (Accession # HM044665); Cry8Ma2 (Accession # EEM86551); Cry8Ma3 (Accession # HM210574); Cry8Na1 (Accession # HM640939); Cry8Pa1 (Accession #HQ388415); Cry8Qa1 (Accession # HQ441166); Cry8Qa2 (Accession # KC152468); Cry8Ra1 (Accession # AFP87548); Cry8Sa1 (Accession # JQ740599); Cry8Ta1 (Accession #KC156673); Cry8-like (Accession # FJ770571); Cry8-like (Accession # ABS53003); Cry9Aa1 (Accession # CAA41122); Cry9Aa2 (Accession # CAA41425); Cry9Aa3 (Accession #GQ249293); Cry9Aa4 (Accession # GQ249294); Cry9Aa5 (Accession # JX174110); Cry9Aa like (Accession # AAQ52376); Cry9Ba1 (Accession # CAA52927); Cry9Ba2 (Accession #GU299522); Cry9Bb1 (Accession # AAV28716); Cry9Ca1 (Accession # CAA85764); Cry9Ca2 (Accession # AAQ52375); Cry9Da1 (Accession # BAA19948); Cry9Da2 (Accession # AAB97923); Cry9Da3 (Accession # GQ249293); Cry9Da4 (Accession # GQ249297); Cry9Db1 (Accession # AAX78439); Cry9Dc1 (Accession # KC156683); Cry9Ea1 (Accession # BAA34908); Cry9Ea2 (Accession # AA012908); Cry9Ea3 (Accession # ABM21765); Cry9Ea4 (Accession # ACE88267); Cry9Ea5 (Accession # ACF04743); Cry9Ea6 (Accession # ACG63872); Cry9Ea7 (Accession # FJ380927); Cry9Ea8 (Accession # GQ249292); Cry9Ea9 (Accession # JN651495); Cry9Eb1 (Accession # CAC50780); Cry9Eb2 (Accession # GQ249298); Cry9Eb3 (Accession # KC156646); Cry9Ec1 (Accession # AAC63366); Cry9Ed1 (Accession # AAX78440); Cry9Ee1 (Accession # GQ249296); Cry9Ee2 (Accession # KC156664); Cry9Fa1 (Accession # KC156692); Cry9Ga1 (Accession # KC156699); Cry9-like (Accession # AAC63366); Cry10Aa1 (Accession # AAA22614); Cry10Aa2 (Accession #E00614); Cry10Aa3 (Accession # CAD30098); Cry10Aa4 (Accession # AFB18318); Cry10A-like (Accession # DQ167578); Cry11Aa1 (Accession # AAA22352); Cry11Aa2 (Accession #AAA22611); Cry11Aa3 (Accession # CAD30081); Cry11Aa4 (Accession # AFB18319); Cry11Aa-like (Accession # DQ166531); Cry11Ba1 (Accession # CAA60504); Cry11Bb1 (Accession # AAC97162); Cry11Bb2 (Accession # HM068615); Cry12Aa1 (Accession #AAA22355); Cry13Aa1 (Accession # AAA22356); Cry14Aa1 (Accession # AAA21516); Cry14Ab1 (Accession # KC156652); Cry15Aa1 (Accession # AAA22333); Cry16Aa1 (Accession # CAA63860); Cry17Aa1 (Accession # CAA67841); Cry18Aa1 (Accession #CAA67506); Cry18Ba1 (Accession # AAF89667); Cry18Ca1 (Accession # AAF89668); Cry19Aa1 (Accession # CAA68875); Cry19Ba1 (Accession # BAA32397); Cry19Ca1 (Accession # AFM37572); Cry20Aa1 (Accession # AAB93476); Cry20Ba1 (Accession #ACS93601); Cry20Ba2 (Accession # KC156694); Cry20-like (Accession # GQ144333); Cry21Aa1 (Accession # I32932); Cry21Aa2 (Accession # I66477); Cry21Ba1 (Accession #BAC06484); Cry21Ca1 (Accession # JF521577); Cry21Ca2 (Accession # KC156687); Cry21Da1 (Accession # JF521578); Cry22Aa1 (Accession # I34547); Cry22Aa2 (Accession #CAD43579); Cry22Aa3 (Accession # ACD93211); Cry22Ab1 (Accession # AAK50456); Cry22Ab2 (Accession # CAD43577); Cry22Ba1 (Accession # CAD43578); Cry22Bb1 (Accession # KC156672); Cry23Aa1 (Accession # AAF76375); Cry24Aa1 (Accession #AAC61891); Cry24Ba1 (Accession # BAD32657); Cry24Ca1 (Accession # CAJ43600); Cry25Aa1 (Accession # AAC61892); Cry26Aa1 (Accession # AAD25075); Cry27Aa1 (Accession # BAA82796); Cry28Aa1 (Accession # AAD24189); Cry28Aa2 (Accession #AAG00235); Cry29Aa1 (Accession # CAC80985); Cry30Aa1 (Accession # CAC80986); Cry30Ba1 (Accession # BAD00052); Cry30Ca1 (Accession #BAD67157); Cry30Ca2 (Accession # ACU24781); Cry30Da1 (Accession # EF095955); Cry30Db1 (Accession #BAE80088); Cry30Ea1 (Accession # ACC95445); Cry30Ea2 (Accession # FJ499389); Cry30Fa1 (Accession # AC122625); Cry30Ga1 (Accession # ACG60020); Cry30Ga2 (Accession # HQ638217); Cry31Aa1 (Accession # BAB11757); Cry31Aa2 (Accession #AAL87458); Cry31Aa3 (Accession # BAE79808); Cry31Aa4 (Accession # BAF32571); Cry31Aa5 (Accession # BAF32572); Cry31Aa6 (Accession # BAI44026); Cry31Ab1 (Accession # BAE79809); Cry31Ab2 (Accession # BAF32570); Cry31Ac1 (Accession #BAF34368); Cry31Ac2 (Accession # AB731600); Cry31Ad1 (Accession # BAI44022); Cry32Aa1 (Accession # AAG36711); Cry32Aa2 (Accession # GU063849); Cry32Ab1 (Accession # GU063850); Cry32Ba1 (Accession # BAB78601); Cry32Ca1 (Accession #BAB78602); Cry32Cb1 (Accession # KC156708); Cry32Da1 (Accession # BAB78603);

Cry32Ea1 (Accession # GU324274); Cry32Ea2 (Accession # KC156686); Cry32Eb1 (Accession # KC156663); Cry32Fa1 (Accession # KC156656); Cry32Ga1 (Accession #KC156657); Cry32Ha1 (Accession # KC156661); Cry32Hb1 (Accession # KC156666); Cry32Ia1 (Accession # KC156667); Cry32Ja1 (Accession # KC156685); Cry32Ka1 (Accession # KC156688); Cry32La1 (Accession # KC156689); Cry32Ma1 (Accession #KC156690); Cry32Mb1 (Accession # KC156704); Cry32Na1 (Accession # KC156691); Cry32Oa1 (Accession # KC156703); Cry32Pa1 (Accession # KC156705); Cry32Qa1 (Accession # KC156706); Cry32Ra1 (Accession # KC156707); Cry32Sa1 (Accession #KC156709); Cry32Ta1 (Accession # KC156710); Cry32Ua1 (Accession # KC156655); Cry33Aa1 (Accession # AAL26871); Cry34Aa1 (Accession # AAG50341); Cry34Aa2 (Accession # AAK64560); Cry34Aa3 (Accession # AAT29032); Cry34Aa4 (Accession #AAT29030); Cry34Ab1 (Accession # AAG41671); Cry34Ac1 (Accession # AAG50118); Cry34Ac2 (Accession # AAK64562); Cry34Ac3 (Accession # AAT29029); Cry34Ba1 (Accession # AAK64565); Cry34Ba2 (Accession # AAT29033); Cry34Ba3 (Accession #AAT29031); Cry35Aa1 (Accession # AAG50342); Cry35Aa2 (Accession # AAK64561); Cry35Aa3 (Accession # AAT29028); Cry35Aa4 (Accession # AAT29025); Cry35Ab1 (Accession # AAG41672); Cry35Ab2 (Accession # AAK64563); Cry35Ab3 (Accession #AY536891); Cry35Ac1 (Accession # AAG50117); Cry35Ba1 (Accession # AAK64566); Cry35Ba2 (Accession # AAT29027); Cry35Ba3 (Accession # AAT29026); Cry36Aa1 (Accession # AAK64558); Cry37Aa1 (Accession # AAF76376); Cry38Aa1 (Accession #AAK64559); Cry39Aa1 (Accession # BAB72016); Cry40Aa1 (Accession # BAB72018); Cry40Ba1 (Accession # BAC77648); Cry40Ca1 (Accession # EU381045); Cry40Da1 (Accession # ACF15199); Cry41Aa1 (Accession # BAD35157); Cry41Ab1 (Accession #BAD35163); Cry41Ba1 (Accession # HM461871); Cry41Ba2 (Accession # ZP_04099652); Cry42Aa1 (Accession # BAD35166); Cry43Aa1 (Accession # BAD15301); Cry43Aa2 (Accession # BAD95474); Cry43Ba1 (Accession # BAD15303); Cry43Ca1 (Accession #KC156676); Cry43Cb1 (Accession # KC156695); Cry43Cc1 (Accession # KC156696); Cry43-like (Accession # BAD15305); Cry44Aa (Accession # BAD08532); Cry45Aa (Accession #BAD22577); Cry46Aa (Accession # BAC79010); Cry46Aa2 (Accession # BAG68906); Cry46Ab (Accession # BAD35170); Cry47Aa (Accession # AAY24695); Cry48Aa (Accession # CAJ18351); Cry48Aa2 (Accession # CAJ86545); Cry48Aa3 (Accession # CAJ86546); Cry48Ab (Accession # CAJ86548); Cry48Ab2 (Accession # CAJ86549); Cry49Aa (Accession # CAH56541); Cry49Aa2 (Accession # CAJ86541); Cry49Aa3 (Accession # CAJ86543); Cry49Aa4 (Accession # CAJ86544); Cry49Ab1 (Accession # CAJ86542); Cry50Aa1 (Accession # BAE86999); Cry50Ba1 (Accession # GU446675); Cry50Ba2 (Accession #GU446676); Cry51Aa1 (Accession # AB114444); Cry51Aa2 (Accession # GU570697); Cry52Aa1 (Accession # EF613489); Cry52Ba1 (Accession # FJ361760); Cry53Aa1 (Accession # EF633476); Cry53Ab1 (Accession # FJ361759); Cry54Aa1 (Accession #ACA52194); Cry54Aa2 (Accession # GQ140349); Cry54Ba1 (Accession # GU446677); Cry55Aa1 (Accession # ABW88932); Cry54Ab1 (Accession # JQ916908); Cry55Aa2 (Accession # AAE33526); Cry56Aa1 (Accession # ACU57499); Cry56Aa2 (Accession #GQ483512); Cry56Aa3 (Accession # JX025567); Cry57Aa1 (Accession # ANC87261); Cry58Aa1 (Accession # ANC87260); Cry59Ba1 (Accession # JN790647); Cry59Aa1 (Accession # ACR43758); Cry60Aa1 (Accession #ACU24782); Cry60Aa2 (Accession #EA057254); Cry60Aa3 (Accession # EEM99278); Cry60Ba1 (Accession # GU810818); Cry60Ba2 (Accession # EA057253); Cry60Ba3 (Accession # EEM99279); Cry61Aa1 (Accession #HM035087); Cry61Aa2 (Accession # HM132125); Cry61Aa3 (Accession #EEM19308); Cry62Aa1 (Accession #HM054509); Cry63Aa1 (Accession # BAI44028); Cry64Aa1 (Accession # BAJ05397); Cry65Aa1 (Accession #HM461868); Cry65Aa2 (Accession # ZP_04123838); Cry66Aa1 (Accession # HM485581); Cry66Aa2 (Accession #ZP_04099945); Cry67Aa1 (Accession # HM485582); Cry67Aa2 (Accession # ZP_04148882); Cry68Aa1 (Accession # HQ113114); Cry69Aa1 (Accession # HQ401006); Cry69Aa2 (Accession # JQ821388); Cry69Ab1 (Accession # JN209957); Cry70Aa1 (Accession #JN646781); Cry70Ba1 (Accession # ADO51070); Cry70Bb1 (Accession # EEL67276); Cry71Aa1 (Accession # JX025568); Cry72Aa1 (Accession # JX025569); Cyt1Aa (GenBank Accession Number X03182); Cyt1Ab (GenBank Accession Number X98793); Cyt1B (GenBank Accession Number U37196); Cyt2A (GenBank Accession Number Z14147); and Cyt2B (GenBank Accession Number U52043).

Examples of δ-endotoxins also include but are not limited to Cry1A proteins of U.S. Pat. Nos. 5,880,275 and 7,858,849; a DIG-3 or DIG-11 toxin (N-terminal deletion of α-helix 1 and/or α-helix 2 variants of cry proteins such as Cry1A, Cry3A) of U.S. Pat. Nos. 8,304,604, 8,304,605 and 8,476,226; Cry1B of U.S. patent application Ser. No. 10/525,318; Cry1C of U.S. Pat. No. 6,033,874; Cry1F of U.S. Pat. Nos. 5,188,960 and 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,378,499 and 7,462,760; a Cry9 protein such as such as members of the Cry9A, Cry9B, Cry9C, Cry9D, Cry9E and Cry9F families; a Cry15 protein of Naimov, et al., (2008) *Applied and Environmental Microbiology,* 74:7145-7151; a Cry22, a Cry34Ab1 protein of U.S. Pat. Nos. 6,127,180, 6,624,145 and 6,340,593; a CryET33 and cryET34 protein of U.S. Pat. Nos. 6,248,535, 6,326,351, 6,399,330, 6,949,626, 7,385,107 and 7,504,229; a CryET33 and CryET34 homologs of US Patent Publication Number 2006/0191034, 2012/0278954, and PCT Publication Number WO 2012/139004; a Cry35Ab1 protein of U.S. Pat. Nos. 6,083,499, 6,548,291 and 6,340,593; a Cry46 protein, a Cry 51 protein, a Cry binary toxin; a TIC901 or related toxin; TIC807 of US Patent Application Publication Number 2008/0295207; ET29, ET37, TIC809, TIC810, TIC812, TIC127, TIC128 of PCT US 2006/033867; AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020 and AXMI-021 of WO 2006/083891; AXMI-010 of WO 2005/038032; AXMI-003 of WO 2005/021585; AXMI-008 of US Patent Application Publication Number 2004/0250311; AXMI-006 of US Patent Application Publication Number 2004/0216186; AXMI-007 of US Patent Application Publication Number 2004/0210965; AXMI-009 of US Patent Application Number 2004/0210964; AXMI-014 of US Patent Application Publication Number 2004/0197917; AXMI-004 of US Patent Application Publication Number 2004/0197916; AXMI-028 and AXMI-029 of WO 2006/119457; AXMI-007, AXMI-008, AXMI-0080rf2, AXMI-009, AXMI-014 and AXMI-004 of WO 2004/074462; AXMI-150 of U.S. Pat. No. 8,084,416; AXMI-205 of US Patent Application Publication Number 2011/0023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063 and AXMI-064 of US Patent Application Publication Number 2011/0263488; AXMI-R1 and related proteins of US Patent Application Publication Number 2010/0197592; AXMI221Z, AXMI222z, AXMI223z, AXMI224z and AXMI225z of WO 2011/103248; AXMI218, AXMI219, AXMI220, AXMI1226, AXM1227, AXM1228, AXM1229, AXMI230 and AXMI231 of WO 2011/103247; AXMI-115, AXMI-113, AXMI-005, AXMI-163 and AXMI-184 of U.S. Pat. No. 8,334,431; AXMI-001, AXMI-002, AXMI-030, AXMI-035 and AXMI-045 of US Patent Application Publication Number 2010/0298211; AXMI-066 and AXMI-076 of US Patent Application Publication Number 2009/0144852; AXMI128, AXM1130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXM11257, AXM11268, AXMI127, AXMI129, AXMI164, AXMI151, AXMI161, AXMI183, AXMI132, AXMI138, AXMI137 of US Patent Application Publication Number 2010/0005543, cry proteins such as Cry1A and Cry3A having modified proteolytic sites of U.S. Pat. No. 8,319,019; a Cry1Ac, Cry2Aa and Cry1Ca toxin protein from *Bacillus thuringiensis* strain VBTS 2528 of US Patent Application Publication Number 2011/0064710. Other Cry proteins are well known to one skilled in the art (see, Crickmore, et al., "*Bacillus thuringiensis* toxin nomenclature" (2011), at lifesci.sussex.ac.uk/home/Neil_Crickmore/Bt/ which can be accessed on the world-wide web using the "www" prefix). The insecticidal activity of Cry proteins is well known to one skilled in the art (for review, see, van Frannkenhuyzen, (2009) *J. Invert. Path.* 101:1-16). The use of Cry proteins as transgenic plant traits is well known to one skilled in the art and Cry-transgenic plants including but not limited to plants expressing Cry1Ac, Cry1Ac+Cry2Ab, Cry1Ab, Cry1A.105, Cry1F, Cry1Fa2, Cry1F+Cry1Ac, Cry2Ab, Cry3A, mCry3A, Cry3Bb1, Cry34Ab1, Cry35Ab1, Vip3A, mCry3A, Cry9c and CBI-Bt have received regulatory approval (see, Sanahuja, (2011) *Plant Biotech Journal* 9:283-300 and the CERA. (2010) GM Crop Database Center for Environmental Risk Assessment (CERA), ILSI Research Foundation, Washington D.C. at cera-gmc.org/index.php?action=gm_crop_database which can be accessed on the world-wide web using the "www" prefix). More than one pesticidal proteins well known to one skilled in the art can also be expressed in plants such as Vip3Ab & Cry1Fa (US2012/0317682); Cry1BE & Cry1F (US2012/0311746); Cry1CA & Cry1AB (US2012/0311745); Cry1F & CryCa (US2012/0317681); Cry1DA & Cry1BE (US2012/0331590); Cry1DA & Cry1Fa (US2012/0331589); Cry1AB & Cry1BE (US2012/0324606); Cry1Fa & Cry2Aa and Cry1I & Cry1E (US2012/0324605); Cry34Ab1/35Ab and Cry6Aa (US20130167269); Cry34Ab/VCry35Ab & Cry3Aa (US20130167268); and Cry3A and Cry1Ab or Vip3Aa (US20130116170). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279 6,137,033, 7,244,820, 7,615,686, and 8,237,020 and the like. Other VIP proteins are well known to one skilled in the art (see, lifesci.sussex-.ac.uk/home/Neil_Crickmore/Bt/vip.html which can be accessed on the world-wide web using the "www" prefix). Pesticidal proteins also include toxin complex (TC) proteins, obtainable from organisms such as *Xenorhabdus, Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but not limited to lycotoxin-1 peptides and mutants thereof (U.S. Pat. No. 8,334,366).

In some embodiments the PtIP-83 polypeptide include amino acid sequences deduced from the full-length nucleic acid sequences disclosed herein and amino acid sequences that are shorter than the full-length sequences, either due to the use of an alternate downstream start site or due to processing that produces a shorter protein having pesticidal activity. Processing may occur in the organism the protein is expressed in or in the pest after ingestion of the protein.

Thus, provided herein are novel isolated or recombinant nucleic acid sequences that confer pesticidal activity. Also provided are the amino acid sequences of PtIP-83 polypeptides. The protein resulting from translation of these PtIP-83 polypeptide genes allows cells to control or kill pests that ingest it.

Nucleic Acid Molecules, and Variants and Fragments Thereof

One aspect pertains to isolated or recombinant nucleic acid molecules comprising nucleic acid sequences encoding PtIP-83 polypeptides or biologically active portions thereof, as well as nucleic acid molecules sufficient for use as hybridization probes to identify nucleic acid molecules encoding proteins with regions of sequence homology. As used herein, the term "nucleic acid molecule" refers to DNA molecules (e.g., recombinant DNA, cDNA, genomic DNA, plastid DNA, mitochondrial DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule (or DNA) is used herein to refer to a nucleic acid sequence (or DNA) that is no longer in its natural environment, for example in vitro. A "recombinant" nucleic acid molecule (or DNA) is used herein to refer to a nucleic acid sequence (or DNA) that is in a recombinant bacterial or plant host cell. In some embodiments, an "isolated" or "recombinant" nucleic acid is free of sequences (preferably protein encoding sequences) that naturally flank the nucleic acid (i.e., sequences located at the 5' and 3' ends of the nucleic acid) in the genomic DNA of the organism from which the nucleic acid is derived. For purposes of the disclosure, "isolated" or "recombinant" when used to refer to nucleic acid molecules excludes isolated chromosomes. For example, in various embodiments, the recombinant nucleic acid molecule encoding PtIP-83 polypeptides can contain less than about 5 kb, 4 kb, 3 kb, 2 kb, 1 kb, 0.5 kb or 0.1 kb of nucleic acid sequences that naturally flank the nucleic acid molecule in genomic DNA of the cell from which the nucleic acid is derived.

In some embodiments an isolated nucleic acid molecule encoding PtIP-83 polypeptides has one or more change in the nucleic acid sequence compared to the native or genomic nucleic acid sequence. In some embodiments the change in the native or genomic nucleic acid sequence includes but is not limited to: changes in the nucleic acid sequence due to the degeneracy of the genetic code; changes in the nucleic acid sequence due to the amino acid substitution, insertion, deletion and/or addition compared to the native or genomic sequence; removal of one or more intron; deletion of one or more upstream or downstream regulatory regions; and deletion of the 5' and/or 3' untranslated region associated with the genomic nucleic acid sequence. In some embodiments the nucleic acid molecule encoding a PtIP-83 polypeptide is a non-genomic sequence.

A variety of polynucleotides that encode PtIP-83 polypeptides or related proteins are contemplated. Such polynucleotides are useful for production of PtIP-83 polypeptides in host cells when operably linked to suitable promoter, transcription termination and/or polyadenylation sequences. Such polynucleotides are also useful as probes for isolating homologous or substantially homologous polynucleotides that encode PtIP-83 polypeptides or related proteins.

Polynucleotides Encoding PtIP-83 Polypeptides

One source of polynucleotides that encode PtIP-83 polypeptides or related proteins is a fern or other primitive plant species which contains a PtIP-83 polynucleotide of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 717, SEQ ID NO: 738, SEQ ID NO: 739, SEQ ID NO: 740, SEQ ID NO: 741, SEQ ID NO: 742, SEQ ID NO: 743, SEQ ID NO: 744, SEQ ID NO: 745, SEQ ID NO: 746, SEQ ID NO: 747, SEQ ID NO: 748, SEQ ID NO: 749, SEQ ID NO: 750, SEQ ID NO: 751, SEQ ID NO: 752 or SEQ ID NO: 753, encoding a PtIP-83 polypeptide of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769. The polynucleotides of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 717, SEQ ID NO: 738, SEQ ID NO: 739, SEQ ID NO: 740, SEQ ID NO: 741, SEQ ID NO: 742, SEQ ID NO: 743, SEQ ID NO: 744, SEQ ID NO: 745, SEQ ID NO: 746, SEQ ID NO: 747, SEQ ID NO: 748, SEQ ID NO: 749, SEQ ID NO: 750, SEQ ID NO: 751, SEQ ID NO: 752 and SEQ ID NO: 753 can be used to express PtIP-83 polypeptides in bacterial hosts that include but are not limited to *Agrobacterium, Bacillus, Escherichia, Salmonella, Pseudomonas* and *Rhizobium* bacterial host cells. The polynucleotides are also useful as probes for isolating homologous or substantially homologous polynucleotides that encode PtIP-83 polypeptides or related proteins. Such probes can be used to identify homologous or substantially homologous polynucleotides derived from *Pteridophyta* species.

Polynucleotides that encode PtIP-83 polypeptides can also be synthesized de novo from a PtIP-83 polypeptide sequence. The sequence of the polynucleotide gene can be deduced from a PtIP-83 polypeptide sequence through use of the genetic code. Computer programs such as "Back-Translate" (GCG™ Package, Acclerys, Inc. San Diego, Calif.) can be used to convert a peptide sequence to the corresponding nucleotide sequence encoding the peptide. Examples of PtIP-83 polypeptide sequences that can be used to obtain corresponding nucleotide encoding sequences include, but are not limited to the PtIP-83 polypeptides of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, and SEQ ID NO: 769. Furthermore, synthetic PtIP-83 polynucleotide sequences of the disclosure can be designed so that they will be expressed in plants. U.S. Pat. No. 5,500,365 describes a method for synthesizing plant genes to improve the expression level of the protein encoded by the synthesized gene. This method relates to the modification of the structural gene sequences of the exogenous transgene, to cause them to be more efficiently transcribed, processed, translated and expressed by the plant. Features of genes that are expressed well in plants include elimination of sequences that can cause undesired intron splicing or polyadenylation in the coding region of a gene transcript while retaining substantially the amino acid sequence of the toxic portion of the insecticidal protein. A similar method for obtaining enhanced expression of transgenes in monocotyledonous plants is disclosed in U.S. Pat. No. 5,689,052.

In some embodiments the nucleic acid molecule encoding a PtIP-83 polypeptide is a polynucleotide having the sequence set forth in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 717, SEQ ID NO: 738, SEQ ID NO: 739, SEQ ID NO: 740, SEQ ID NO: 741, SEQ ID NO: 742, SEQ ID NO: 743, SEQ ID NO: 744, SEQ ID NO: 745, SEQ ID NO: 746, SEQ ID NO: 747, SEQ ID NO: 748, SEQ ID NO: 749, SEQ ID NO: 750, SEQ ID NO: 751, SEQ ID NO: 752, SEQ ID NO: 753, and variants, fragments and complements thereof. "Complement" is used herein to refer to a nucleic acid sequence that is sufficiently complementary to a given nucleic acid sequence such that it can hybridize to the given nucleic acid sequence to thereby form a stable duplex. "Polynucleotide sequence variants" is used herein to refer to a nucleic acid sequence that except for the degeneracy of the genetic code encodes the same polypeptide.

In some embodiments the nucleic acid molecule encoding the PtIP-83 polypeptide is a non-genomic nucleic acid sequence. As used herein a "non-genomic nucleic acid sequence" or "non-genomic nucleic acid molecule" or "non-genomic polynucleotide" refers to a nucleic acid molecule that has one or more change in the nucleic acid sequence compared to a native or genomic nucleic acid sequence. In some embodiments the change to a native or genomic nucleic acid molecule includes but is not limited to: changes in the nucleic acid sequence due to the degeneracy of the genetic code; codon optimization of the nucleic acid sequence for expression in plants; changes in the nucleic acid sequence to introduce at least one amino acid substitution, insertion, deletion and/or addition compared to the native or genomic sequence; removal of one or more intron associated with the genomic nucleic acid sequence; insertion of one or more heterologous introns; deletion of one or more upstream or downstream regulatory regions associated with the genomic nucleic acid sequence; insertion of one or more heterologous upstream or downstream regulatory regions; deletion of the 5' and/or 3' untranslated region associated with the genomic nucleic acid sequence; insertion of a heterologous 5' and/or 3' untranslated region; and modification of a polyadenylation site. In some embodiments the non-genomic nucleic acid molecule is a cDNA. In some embodiments the non-genomic nucleic acid molecule is a synthetic nucleic acid sequence.

In some embodiments the nucleic acid molecule encoding a PtIP-83 polypeptide is a the non-genomic polynucleotide having a nucleotide sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity, to the nucleic acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 717, SEQ ID NO: 738, SEQ ID NO: 739, SEQ ID NO: 740, SEQ ID NO: 741, SEQ ID NO: 742, SEQ ID NO: 743, SEQ ID NO: 744, SEQ ID NO: 745, SEQ ID NO: 746, SEQ ID NO: 747, SEQ ID NO: 748, SEQ ID NO: 749, SEQ ID NO: 750, SEQ ID NO: 751, SEQ ID NO: 752 or SEQ ID NO: 753, wherein the PtIP-83 polypeptide has insecticidal activity.

In some embodiments the non-genomic polynucleotide is not the nucleic acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 717, SEQ ID NO: 738, SEQ ID NO: 739, SEQ ID NO: 740, SEQ ID NO: 741, SEQ ID NO: 742, SEQ ID NO: 743, SEQ ID NO: 744, SEQ ID NO: 745, SEQ ID NO: 746, SEQ ID NO: 747, SEQ ID NO: 748, SEQ ID NO: 749, SEQ ID NO: 750, SEQ ID NO: 751, SEQ ID NO: 752 or SEQ ID NO: 753.

In some embodiments the nucleic acid molecule encodes a PtIP-83 polypeptide comprising an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769, wherein the PtIP-83 polypeptide has insecticidal activity.

In some embodiments the nucleic acid molecule encodes a PtIP-83 polypeptide comprising an amino acid sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769, having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70 or more amino acid substitutions compared to the native amino acid at the corresponding position of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769.

In some embodiments the nucleic acid molecule encodes a PtIP-83 polypeptide comprising an amino acid sequence of any one of SEQ ID NO: 236-299, SEQ ID NO: 334-367, SEQ ID NO: 398-427, SEQ ID NO: 518-607, SEQ ID NO: 640-645, and SEQ ID NO: 728-737.

In some embodiments the nucleic acid molecule encoding the PtIP-83 polypeptide is any one of SEQ ID NO: 172-235, SEQ ID NO: 300-333, SEQ ID NO: 368-397, SEQ ID NO: 428-517, SEQ ID NO: 634-639, and SEQ ID NO: 718-727.

In some embodiments the nucleic acid molecule encodes a PtIP-83 polypeptide variant of SEQ ID NO: 1, wherein the amino acid at position 53 is Val, Ala, Cys or Thr; the amino acid at position 54 is Lys, Ala, Cys, Asp, Glu, Gly, His, Ile, Leu, Met, Asn, Gln, Arg, Ser or Thr; the amino acid at position 55 is Arg, Ala, Asp, Glu, Phe, Gly, His, Lys, Leu, Met, Asn, Gln, Ser, Thr, Val, Trp or Tyr; the amino acid at position 56 is Leu, Glu, Phe, Ile, Met, Thr or Val; the amino acid at position 57 is Tyr, Cys, Ile, Leu, Met, Thr or Val; the amino acid at position 58 is Val, Cys, Ile or Leu; the amino acid at position 59 is Phe, Leu, Met, Val or Tyr; the amino acid at position 60 is Ala, Cys, Gly, Ser, Thr or Val; the amino acid at position 61 is Asp, Glu, His or Ser; the amino acid at position 62 is Val, Ala, Cys, Ile, Leu or Thr; the amino acid at position 63 is Val, Ala, Cys, Ile, Leu, Met or Thr; the amino acid at position 64 is Glu, Ala, Cys, Phe, Gly, His, Ile, Leu, Met, Asn, Gln, Arg, Ser, Thr, Val, Trp or Tyr; the amino acid at position 65 is Leu, Ala, Cys, Phe, His, Ile, Met, Asn, Gln, Thr, Val or Trp; the amino acid at position 66 is Pro, Asp, Gly, Met, Gln or Arg; the amino acid at position 363 is Gln, Ala, Cys, Glu, Phe, Gly, His, Lys, Leu, Asn, Arg, Ser, Thr, Val or Trp; the amino acid at position 364 is Ile, Ala, Cys, Glu, Phe, His, Lys, Leu, Met, Asn, Gln, Ser, Thr, Val, Trp or Tyr; the amino acid at position 365 is Leu, Ala, Glu, Phe, Gly, His, Ile, Lys, Met, Asn, Arg, Val, Trp or Tyr; the amino acid at position 366 is Gly, Ala, Cys, Phe, His, Ile, Lys, Leu, Met, Asn, Ser, Thr or Val; the amino acid at position 367 is Ser, Ala, Cys, Asp, Glu, Phe, Gly, His, Ile, Leu, Met, Asn, Pro, Gln, Arg, Thr, Val or Trp; the amino acid at position 368 is Tyr, Ala, Cys, Asp, Glu, Phe, Gly, His, Ile, Lys, Leu, Met, Asn, Pro, Gln, Arg, Ser, Thr, Val or Trp; the amino acid at position 369 is Leu, Ala, Cys, Asp, Phe, Gly, Ile, Met, Thr or Val; the amino acid at position 370 is Leu, Ala, Cys, Asp, Glu, Phe, Gly, His, Ile, Lys, Met, Gln, Arg, Ser, Thr, Val, Trp or Tyr; the amino acid at position 371 is Gln, Ala, Cys, Asp, Glu, Phe, Gly, Ile, Lys, Leu, Asn, Arg, Ser, Thr, Val or Trp; the amino acid at position 372 is Gln, Ala, Cys, Asp, Phe, Gly, His, Ile, Leu, Asn, Arg, Ser, Val or Tyr; the amino acid at position 373 is Asn, Ala, Cys, Asp, Phe, Gly, His, Ile, Lys, Gln, Ser, Thr, Val or Trp; the amino acid at position 556 is Trp, Phe, Thr or Tyr; the amino acid at position 557 is Arg, Cys, Asp, Gly, His, Ile, Lys, Leu, Met, Asn, Pro, Gln, Ser, Thr, Val, Trp or Tyr; the amino acid at position 558 is Ala, Cys, Asp, Phe, Gly, His, Ile, Lys, Leu, Asn, Pro, Gln, Arg, Ser, Val, Trp or Tyr; the amino acid at position 559 is Lys, Ala, Cys, Phe, Gly, His, Ile, Leu, Asn, Gln, Arg, Ser, Thr, Val or Tyr; the amino acid at position 560 is Cys, Ala, Phe, Gly, Ile, Met, Asn, Arg, Ser, Thr or Val; the amino acid at position 561 is Lys, Ala, Cys, Asp, Glu, Phe, Gly, His, Ile, Leu, Met, Asn, Arg, Ser, Thr, Val or Tyr; the amino acid at position 562 is Asn, Cys, Asp, Glu, Gly, His, Leu, Met, Arg, Ser, Thr, Val or Tyr; the amino acid at position 563 is Val, Ala, Cys, Asp, Phe, His, Ile, Leu, Met, Asn, Gln, Thr or Trp; the amino acid at position 564 is Ala, Cys, Gly, Met, Gln, Ser, Thr, Val, Trp or Tyr; the amino acid at position 646 is Leu, Ala, Cys, Gly, Ile, Met, Asn, Gln, Ser, Thr or Val; the amino acid at position 647 is Leu, Asp, Gly, Met, Asn, Gln or Thr; the amino acid at position 648 is Met, Ala, Cys, Asp, Glu, Phe, Gly, His, Lys, Leu, Asn, Pro, Gln, Arg, Ser, Thr, Val, Trp or Tyr; the amino acid at position 649 is Pro, Ala, Cys, Asp, Glu, Phe, Gly, His, Lys, Met, Asn, Gln, Arg, Ser, Thr, Trp or Tyr; the amino acid at position 650 is Thr, Ala, Cys, Asp, Phe, Gly, His, Ile, Lys, Leu, Met, Pro, Gln, Arg, Ser, Val or Tyr; the amino acid at position 651 is Glu, Ala, Cys, Asp, Gly, His, Ile, Leu, Met, Asn, Pro, Gln, Arg, Ser, Thr, Val or Tyr; the amino acid at position 652 is Leu, Cys, Phe, Ile, Lys, Met, Pro, Arg, Ser, Thr or Val; the amino acid at position 653 is Thr, Cys, Asp, Glu, Phe, Gly, His, Ile, Lys, Leu, Pro, Arg, Ser, Val or Trp; the amino acid at position 654 is Thr, Ala, Cys, Phe, Ile, Lys, Leu, Met, Pro, Arg, Ser, Val, Trp or Tyr; the amino acid at position 655 is Trp, Phe or Tyr; the amino acid at position 771 is Arg, Ala, Asp, Glu, Phe, Gly, His, Ile, Lys, Leu, Asn, Ser, Thr, Val, Trp or Tyr; the amino acid at position 772 is Arg, Ala, Cys, Asp, Glu, Phe, Gly, His, Ile, Lys, Leu, Met, Pro, Gln, Ser, Thr, Val, Trp or Tyr; the amino acid at position 773 is Asp, Ala, Glu, Phe, Gly, His, Ile, Lys, Leu, Met, Asn, Gln, Arg, Ser, Thr, Val, Trp or Tyr; the amino acid at position 774 is Gln, Ala, Asp, Gly, His, Ile, Lys, Leu, Met, Asn, Pro, Arg, Ser, Thr, Val, Trp or Tyr; the amino acid at position 775 is Val, Ala, Cys, Asp, Glu, Gly, His, Ile, Asn, Pro, Gln, Arg, Ser, Thr or Tyr; the amino acid at position 776 is Leu, Ala, Cys, Asp, Glu, Phe, Gly, His, Ile, Lys, Asn, Pro, Gln, Arg, Ser, Thr, Val or Tyr; the amino acid at position 777 is Pro, Ala, Cys, Asp, Glu, Phe, Gly, His, Lys, Leu, Met, Asn, Gln, Ser, Thr, Val, Trp or Tyr; the amino acid at position 778 is Phe, Ala, His, Ile, Leu, Met, Asn, Gln, Ser, Val, Trp or Tyr; the amino acid at position 779 is Gln, Ala, Cys, Asp, Glu, Gly, His, Lys, Leu, Asn, Pro, Arg, Ser, Thr or Val; the amino acid at position 780 is Ala, Cys, Asn, Pro, Gln or Ser; the amino acid at position 781 is Ala, Cys, Asp, Glu, Phe, Gly, His, Ile, Asn, Gln, Arg, Ser, Thr, Val, Trp or Tyr; the amino acid at position 782 is Ala, Cys, Asp, Glu, Phe, Gly, His, Ile, Lys, Met, Pro, Gln, Arg, Ser, Thr, Val, Trp or Tyr; the amino acid at position 783 is Pro, Ala, Cys, Asp, Glu, Gly, His, Asn, Gln, Arg, Ser, Thr or Val; the amino acid at position 784 is Leu, Ala, Glu, Phe, His, Ile, Lys, Met, Asn, Pro, Gln, Ser, Thr, Val or Trp; the amino acid at position 785 is Asn, Ala, Cys, Glu, Phe, Gly, His, Ile, Lys, Leu, Met, Gln, Arg, Ser, Thr, Val, Trp or Tyr; and the amino acid at position 786 is Tyr, Phe, Ile, Leu or Trp.

In some embodiments the nucleic acid molecule encodes a PtIP-83 polypeptide variant of SEQ ID NO: 1, wherein the amino acid at position 1 is Met or deleted; the amino acid at position 2 is Ala or deleted; the amino acid at position 3 is Leu, Val or deleted; the amino acid at position 4 is Val, Met or Leu; the amino acid at position 7 is Gly or Ser; the amino acid at position 8 is Lys or Thr; the amino acid at position 10 is Phe or Tyr; the amino acid at position 11 is Glu or Arg; the amino acid at position 18 is Met or Ile; the amino acid at position 19 is Gly, Pro or Ala; the amino acid at position 20 is Val or deleted; the amino acid at position 21 is Leu or Val; the amino acid at position 23 is Arg or Gln; the amino acid at position 37 is Val or Leu; the amino acid at position 38 is Arg or Asn; the amino acid at position 40 is Ala or Ser; the amino acid at position 43 is Asn or Asp; the amino acid at position 45 is Gly or Ala; the amino acid at position 46 is Gln or Glu; the amino acid at position 48 is Glu, Pro or Val; the amino acid at position 51 is Glu or Gly; the amino acid at position 52 is Lys, Arg or Thr; the amino acid at position 56 is Leu or Val; the amino acid at position 59 is Phe or Leu; the amino acid at position 66 is Pro or Ala; the amino acid at position 67 is Val, Pro or Thr; the amino acid at position 68 is Val, Arg, Phe or Gly; the amino acid at position 69 is Glu, Ala or Lys; the amino acid at position 70 is Trp, Thr, His, Tyr or Arg; the amino acid at position 71 is Arg, Pro or deleted; the amino acid at position 72 is Trp, Asp, Leu or deleted; the amino acid at position 73 is Pro, Gln, Asn, His or deleted; the amino acid at position 74 is Pro, Met or Thr; the amino acid at position 75 is Gln, His or Arg; the amino acid at position 76 is Ile, Met or Leu; the amino acid at position 84 is Ile or Val; the amino acid at position 91 is Trp or Phe; the amino acid at position 93 is Thr or Ile; the amino acid at position 94 is Asp or Gly; the amino acid at position 96 is Arg or Ser; the amino acid at position 97 is Gln, Phe or Arg; the amino acid at position 98 is Ser or deleted; the amino acid at position 99 is Asp or Ala; the amino acid at position 100 is Thr or Ala; the amino acid at position 101 is Glu, Thr or Trp the amino acid at position 103 is His, Arg, Glu or Gln; the amino acid at position 105 is Thr or Pro; the amino acid at position 108 is Lys, Gln or Glu; the amino acid at position 109 is Leu or Val; the amino acid at position 111 is Ala or Thr; the amino acid at position 112 is Ile, Arg, Thr or deleted; the amino acid at position 113 is Gln, Ala, Gly or deleted; the amino acid at position 114 is Arg, Glu or Ile; the amino acid at position 115 is Glu or Gln; the amino acid at position 116 is Glu, Asn, Gln or Arg; the amino acid at position 117 is Asn, Val, Tyr or Phe; the amino acid at position 118 is Arg or Lys; the amino acid at position 119 is Trp or Ser; the amino acid at position 122 is Thr, Lys or Ala; the amino acid at position 124 is Ala or Thr; the amino acid at position 126 is Gly or Asp; the amino acid at position 127 is Met or Ala; the amino acid at position 128 is Asn or Lys;

the amino acid at position 131 is Val, Ile or Thr; the amino acid at position 133 is Ile or Val; the amino acid at position 134 is His or Tyr; the amino acid at position 135 is Ala or Gly; the amino acid at position 137 is Glu or Lys; the amino acid at position 139 is Gln or Glu; the amino acid at position 140 is Val, Arg or Leu; the amino acid at position 141 is Gly or Ser; the amino acid at position 142 is Val or Pro; the amino acid at position 144 is Thr, Leu, Phe or Tyr; the amino acid at position 145 is Met, Pro or Asn; the amino acid at position 146 is Ser, Gly or Asn; the amino acid at position 147 is Trp or Asn; the amino acid at position 148 is Ser, Ala or Pro; the amino acid at position 149 is Ser or deleted; the amino acid at position 150 is Val, Ile or Tyr; the amino acid at position 152 is Arg, Ala, Val or Gly; the amino acid at position 154 is Ser, Trp or Glu; the amino acid at position 156 is Leu, Asp or Gln; the amino acid at position 158 is Ser or Cys; the amino acid at position 159 is Val, Thr or Ile; the amino acid at position 162 is Ser or Ala; the amino acid at position 163 is Gly or deleted; the amino acid at position 164 is Phe or deleted; the amino acid at position 165 is Arg or Ala; the amino acid at position 166 is Ala, Arg, Met or Phe; the amino acid at position 167 is Val or His; the amino acid at position 168 is Ser or Asn; the amino acid at position 169 is Val, His or Thr; the amino acid at position 170 is Phe or Val; the amino acid at position 171 is Glu, Asn or Asp; the amino acid at position 172 is Val, Ala, Arg or Glu; the amino acid at position 175 is Ser, Arg or Trp; the amino acid at position 176 is Val or Ile; the amino acid at position 177 is Arg or Ile; the amino acid at position 179 is Thr, Ile, Val or Ser; the amino acid at position 180 is Leu, Phe or Thr; the amino acid at position 181 is Gly, Thr, Gln or Ser; the amino acid at position 182 is Ala, Leu, Phe or Ile; the amino acid at position 183 is Thr or Gly; the amino acid at position 184 is Leu, Thr, Ser or Arg; the amino acid at position 185 is Arg, Gly, Asp or Ala; the amino acid at position 186 is Pro, Val or Gln; the amino acid at position 187 is Asp, Thr or Ser; the amino acid at position 188 is His, Gly or Ala; the amino acid at position 189 is Ala, Arg, Pro or deleted; the amino acid at position 190 is Leu, Asn or deleted; the amino acid at position 191 is Tyr or deleted; the amino acid at position 192 is Ser, Ile, Val or Asn; the amino acid at position 193 is Thr or Asp; the amino acid at position 194 is Thr or Ser; the amino acid at position 195 is Met or Thr; the amino acid at position 196 is Gln, His, Leu or Ser; the amino acid at position 197 is Ala, Gly or Leu; the amino acid at position 198 is Thr, Glu or Ala; the amino acid at position 199 is Pro or Arg; the amino acid at position 200 is Asn, Ser, Thr or Gly; the amino acid at position 201 is Ala, Leu, Glu or Trp; the amino acid at position 202 is Ser, Asp, Phe or Leu; the amino acid at position 203 is His, Pro, Gly or Ser; the amino acid at position 204 is Ile, Trp, His or Gly; the amino acid at position 205 is Ser, Asn or Ile; the amino acid at position 206 is Ala, Gly, Asp, Tyr or Arg; the amino acid at position 207 is Phe, Val or Leu; the amino acid at position 208 is Asn, Ser, Pro or Leu; the amino acid at position 210 is Arg, Asp, Glu or Tyr; the amino acid at position 211 is Ile, Ser or Thr; the amino acid at position 212 is Val, Ala or Asp; the amino acid at position 214 is Pro or Arg; the amino acid at position 215 is Ser or Thr; the amino acid at position 217 is Tyr or Phe; the amino acid at position 218 is Arg or Ser; the amino acid at position 219 is Val or Ala; the amino acid at position 220 is Cys, Leu or Ser; the amino acid at position 221 is Pro or His; the amino acid at position 222 is Leu, Arg or Ser; the amino acid at position 224 is Asn or Ser; the amino acid at position 225 is Asp, Arg or Thr; the amino acid at position 226 is Thr or Asn; the amino acid at position 227 is Asp, Leu or deleted; the amino acid at position 228 is Thr or deleted; the amino acid at position 229 is Tyr or deleted; the amino acid at position 230 is Leu or deleted; the amino acid at position 231 is Gly or deleted; the amino acid at position 232 is Ile or deleted; the amino acid at position 233 is Pro or deleted; the amino acid at position 234 is Ala, Pro or deleted; the amino acid at position 235 is Asp, Ile or Val; the amino acid at position 236 is Val, Ser or Glu; the amino acid at position 237 is Ala, Phe or Tyr; the amino acid at position 238 is Ala or Thr; the amino acid at position 239 is Val, Ser or Gly; the amino acid at position 240 is Leu or Ile; the amino acid at position 243 is Asp or Glu; the amino acid at position 249 is Asn or Ser; the amino acid at position 252 is Leu or Met; the amino acid at position 257 is Thr or Ser; the amino acid at position 259 is His or Leu; the amino acid at position 266 is Ala or Val; the amino acid at position 267 is Cys or Gly; the amino acid at position 268 is His, Arg or Tyr; the amino acid at position 272 is Asp or Glu; the amino acid at position 273 is Val, Met, Ile or Leu; the amino acid at position 274 is Val or Met; the amino acid at position 278 is Gly or Ala; the amino acid at position 279 is Glu or Val; the amino acid at position 281 is Leu or Ala; the amino acid at position 282 is Asn, Leu or Ile; the amino acid at position 285 is Asn or Ser; the amino acid at position 286 is Lys, Asp or Glu; the amino acid at position 287 is Leu or Val; the amino acid at position 290 is Pro, Gln or Arg; the amino acid at position 291 is Leu or Val; the amino acid at position 292 is Lys or Val; the amino acid at position 293 is Glu or Gln; the amino acid at position 294 is Ser, Asn or Lys; the amino acid at position 295 is Thr or Ser; the amino acid at position 296 is Gln or His; the amino acid at position 297 is Leu or Met; the amino acid at position 300 is Ser or Thr; the amino acid at position 301 is Glu or Ala; the amino acid at position 302 is Ser, Pro or Ala; the amino acid at position 304 is Lys or Asn; the amino acid at position 313 is Val or Ile; the amino acid at position 314 is His, Glu or Gln; the amino acid at position 315 is Ala, Cys or Ser; the amino acid at position 316 is Ala or Val; the amino acid at position 317 is Met or Ile; the amino acid at position 319 is Met or Ile; the amino acid at position 320 is Val or Gly; the amino acid at position 321 is Arg or Pro; the amino acid at position 322 is Ile or Phe; the amino acid at position 323 is Gly or Val; the amino acid at position 324 is Leu or Ser; the amino acid at position 336 is Ser or Asn; the amino acid at position 339 is Asn, Lys or Arg; the amino acid at position 350 is Arg or Gln; the amino acid at position 351 is Glu or Asp; the amino acid at position 353 is Lys or Arg; the amino acid at position 354 is Gln or Arg; the amino acid at position 355 is Phe or Leu; the amino acid at position 356 is Lys or Arg; the amino acid at position 360 is Ile, Val or Ala; the amino acid at position 365 is Leu or Phe; the amino acid at position 371 is or Glu; the amino acid at position 372 is or Lys; the amino acid at position 374 is Arg or Lys; the amino acid at position 376 is Phe or Leu; the amino acid at position 378 is Glu or Asp; the amino acid at position 381 is Leu or Val; the amino acid at position 388 is Ala or Ser; the amino acid at position 395 is Arg or Lys; the amino acid at position 396 is Glu, Gln or Gly; the amino acid at position 399 is Asp or Asn; the amino acid at position 400 is Asn, Thr or Asp; the amino acid at position 401 is Thr or Ala; the amino acid at position 402 is Phe, Ile or Leu; the amino acid at position 406 is Asp or Glu; the amino acid at position 408 is Leu or Met; the amino acid at position 410 is Gly or Leu; the amino acid at position 414 is Ala or Glu; the amino acid at position 416 is Ser, Asn or Asp; the amino acid at position 417 is Ser, Arg or Gly; the amino acid at position 423 is Lys or Gln; the amino acid at position 431 is Arg or Lys; the amino acid at position 432 is Gln or Glu; the amino acid at position 436 is Arg or Glu; the amino acid at position 440 is Asn or Arg; the amino acid at position 442 is Leu or Val; the amino acid at position 447 is Ser, Lys or Arg; the amino acid at position 448 is Ala or Ser; the amino acid at position 451 is Gln or Met; the amino acid at position 453 is Gly or Ala; the amino acid at position 455 is Ala or Val; the amino acid at position 457 is Leu or Val; the amino acid at position 467 is Val or Ala; the amino acid at position 471 is Gly or Ala; the amino acid at position 475 is Ser or Asn; the amino acid at position 483 is Gly or Ala; the amino acid at position 493 is Gln or Gly; the amino acid at position 504 is Val or Ile; the amino acid at position 506 is Asp or His; the amino acid at position 509 is Asp or Asn; the amino acid at position 510 is Ser or Ala; the amino acid at position 512 is Glu or Asp; the amino acid at position 515 is Gly or Ser; the amino acid at position 516 is Gln or His; the amino acid at position 517 is Ile or Leu; the amino acid at position 519 is Asp, Gly or Gln; the amino acid at position 522 is Val, Glu, Pro or Val; the amino acid at position 525 is Glu or Asp; the amino acid at position 526 is Leu or Met; the amino acid at position 539 is Val or Ile; the amino acid at position 555 is Val or Ala; the amino acid at position 557 is Arg or Lys; the amino acid at position 563 is Val or Met; the amino acid at position 571 is Ser or Cys; the amino acid at position 575 is Val or Glu; the amino acid at position 577 is Met or Ile; the amino acid at position 579 is Glu or Gln; the amino acid at position 583 is Asp or Glu; the amino acid at position 589 is Met or Leu; the amino acid at position 590 is Met or Leu; the amino acid at position 593 is Met or Ile; the amino acid at position 595 is Arg or Gln; the amino acid at position 596 is Ser or Thr; the amino acid at position 597 is Gln or His; the amino acid at position 607 is Ala or Val; the amino acid at position 608 is Asp or Asn; the amino acid at position 612 is Tyr, His or Phe; the amino acid at position 617 is Thr or Ile; the amino acid at position 618 is Gln or His; the amino acid at position 625 is Arg or Ser; the amino acid at position 626 is Met or Ile; the amino acid at position 628 is Leu or Ile; the amino acid at position 633 is Ile or Met; the amino acid at position 634 is Leu or Met; the amino acid at position 642 is Arg or Met; the amino acid at position 648 is Met or Thr; the amino acid at position 651 is Glu or Gln; the amino acid at position 654 is Thr, Val or Ala; the amino acid at position 658 is Gly or Arg; the amino acid at position 663 is Gly or Ala; the amino acid at position 664 is Asp or Asn; the amino acid at position 668 is Ala or Thr; the amino acid at position 669 is Gln or His; the amino acid at position 671 is Asn or Ser the amino acid at position 675 is Ile, Val or Ser; the amino acid at position 678 is Met, Ile, Ala or Thr; the amino acid at position 682 is Pro or Gln; the amino acid at position 683 is Ser or Pro; the amino acid at position 685 is Asp or Asn; the amino acid at position 694 is Asp or Gly; the amino acid at position 697 is Asn or Ser; the amino acid at position 704 is Glu or Gly; the amino acid at position 714 is Ala or Gly; the amino acid at position 721 is Ser or Phe; the amino acid at position 722 is Ser or Asn; the amino acid at position 724 is Ser or Thr; the amino acid at position 734 is His or Gln; the amino acid at position 736 is Val or Ala; the amino acid at position 737 is Lys or Gln; the amino acid at position 739 is Ala or Ser; the amino acid at position 740 is Ser or Met; the amino acid at position 741 is Gly or Asn; the amino acid at position 742 is Ile or Gly; the amino acid at position 743 is Gly or deleted; the amino acid at position 745 is Gly or Asp; the amino acid at position 751 is Thr, Ser or Ala; the amino acid at position 753 is Gln or Arg; the amino acid at position 754 is Thr or Ser; the amino acid at position 756 is Thr or Ile; the amino acid at position 757 is Val or Ile; the amino acid at position 766 is Ile or Val; the amino acid at position 773 is Asp or Glu; the amino acid at position 774 is Gln or Glu; the amino acid at position 776 is Leu or Met; the amino acid at position 777 is Pro or Thr; the amino acid at position 782 is Ala, Asp or Val; the amino acid at position 786 is Tyr or Phe; the amino acid at position 787 is His or Gln; the amino acid at position 788 is Tyr or Met; the amino acid at position 789 is Ala or Arg; the amino acid at position 790 is Tyr or Thr; the amino acid at position 791 is Arg or Ala; the amino acid at position 792 is Leu or Ser; the amino acid at position 796 is Asp or Glu; the amino acid at position 797 is Ser, Thr or Ala the amino acid at position 802 is Glu or Gln; the amino acid at position 806 is Gln, Asp, Glu or His; the amino acid at position 810 is Lys or Thr; the amino acid at position 819 is Arg or His; the amino acid at position 829 is Lys, Ser, Ala or Pro; the amino acid at position 832 is Ala, Lys or Glu; the amino acid at position 833 is Gly or Glu; the amino acid at position 842 is Leu or Pro; the amino acid at position 847 is Gln or Glu; the amino acid at position 848 is Ile or Val; the amino acid at position 849 is Val or Ala; the amino acid at position 855 is Thr or Met; the amino acid at position 860 is Ile or Val; and the amino acid at position 864 is His or Gln.

In some embodiments the nucleic acid molecule encodes a PtIP-83 polypeptide variant of SEQ ID NO: 1, wherein the amino acid at position 1 is Met or deleted; the amino acid at position 2 is Ala or deleted; the amino acid at position 3 is Leu, Val, Ile or deleted; the amino acid at position 4 is Val, Met, Ile or Leu; the amino acid at position 7 is Gly, Thr or Ser; the amino acid at position 8 is Lys, Arg, Ser or Thr; the amino acid at position 10 is Phe, Trp or Tyr; the amino acid at position 11 is Glu, Asp, Lys or Arg; the amino acid at position 18 is Met, Val, Leu or Ile; the amino acid at position 19 is Gly, Pro or Ala; the amino acid at position 20 is Val, Ile, Leu or deleted; the amino acid at position 21 is Leu, Ile or Val; the amino acid at position 23 is Arg, Lys, Asn or Gln; the amino acid at position 37 is Val, Ile or Leu; the amino acid at position 38 is Arg, Lys, Gln or Asn; the amino acid at position 40 is Ala, Gly, Thr or Ser; the amino acid at position 43 is Asn, Gln, Glu or Asp; the amino acid at position 45 is Gly or Ala; the amino acid at position 46 is Gln, Asp, Asn or Glu; the amino acid at position 48 is Glu, Asp, Pro, Ile, Leu or Val; the amino acid at position 51 is Glu, Asp, Ala or Gly; the amino acid at position 52 is Lys, Arg, Ser or Thr; the amino acid at position 56 is Leu, Ile or Val; the amino acid at position 59 is Phe, Ile, Val or Leu; the amino acid at position 66 is Pro, Gly or Ala; the amino acid at position 67 is Val, Pro, Ile, Leu, Ser or Thr; the amino acid at position 68 is Val, Arg, Phe, Ile, Leu, Lys or Gly; the amino acid at position 69 is Glu, Ala, Asp, Gly, Arg or Lys; the amino acid at position 70 is Trp, Thr, His, Tyr, Lys or Arg; the amino acid at position 71 is Arg, Pro, Lys or deleted; the amino acid at position 72 is Trp, Asp, Leu, Ile, Val, Glu or deleted; the amino acid at position 73 is Pro, Gln, Asn, His or deleted; the amino acid at position 74 is Pro, Met, Ser or Thr; the amino acid at position 75 is Gln, His, Asn, Lys or Arg; the amino acid at position 76 is Ile, Met, Val or Leu; the amino acid at position 84 is Ile, Leu or Val; the amino acid at position 91 is Trp or Phe; the amino acid at position 93 is Thr, Ser, Leu, Val or Ile; the amino acid at position 94 is Asp, Glu, Ala or Gly; the amino acid at position 96 is Arg, Lys, Thr or Ser; the amino acid at position 97 is Gln, Phe, Asn, Lys or Arg; the amino acid at position 98 is Ser, Thr or deleted; the amino acid at position 99 is Asp, Glu, Gly or Ala; the amino acid at position 100 is Thr, Ser, Gly or Ala; the amino acid at position 101 is Glu, Thr, Asp, Ser or Trp the amino acid at position 103 is His, Arg, Lys, Glu or Gln; the amino acid at position 105 is Thr, Ser or Pro; the amino acid at position 108 is Lys, Arg, Asn, Asp, Gln or Glu; the amino acid at position 109 is Leu, Ile or Val; the amino acid at position 111 is Ala, Ser or Thr; the amino acid at position 112 is Ile, Arg, Thr, Leu, Val, Lys, Ser or deleted; the amino acid at position 113 is Gln, Ala, Gly, Asn or deleted; the amino acid at position 114 is Arg, Glu, Lys, Asp or Ile; the amino acid at position 115 is Glu, Asp, Asn or Gln; the amino acid at position 116 is Glu, Asn, Gln, Asp, Lys or Arg; the amino acid at position 117 is Asn, Val, Tyr, Ile, Leu, Gln, Trp or Phe; the amino acid at position 118 is Arg or Lys; the amino acid at position 119 is Trp, Thr or Ser; the amino acid at position 122 is Thr, Lys, Ser, Arg or Ala; the amino acid at position 124 is Ala, Gly, Ser or Thr; the amino acid at position 126 is Gly, Ala, Glu or Asp; the amino acid at position 127 is Met, Gly or Ala; the amino acid at position 128 is Asn, Gln, Arg or Lys; the amino acid at position 131 is Val, Ile, Leu, Ser or Thr; the amino acid at position 133 is Ile, Leu or Val; the amino acid at position 134 is His or Tyr; the amino acid at position 135 is Ala or Gly; the amino acid at position 137 is Glu, Asp, Arg or Lys; the amino acid at position 139 is Gln, Asn, Asp or Glu; the amino acid at position 140 is Val, Arg, Ile, Lys or Leu; the amino acid at position 141 is Gly, Ala, Thr or Ser; the amino acid at position 142 is Val, Ile, Leu or Pro; the amino acid at position 144 is Thr, Leu, Phe, Ile, Val or Tyr; the amino acid at position 145 is Met, Pro, Gln or Asn; the amino acid at position 146 is Ser, Gly, Thr, Ala, Gln or Asn; the amino acid at position 147 is Trp, Gln, Tyr or Asn; the amino acid at position 148 is Ser, Ala, Thr, Gly or Pro; the amino acid at position 149 is Ser, Thr or deleted; the amino acid at position 150 is Val, Ile, Leu or Tyr; the amino acid at position 152 is Arg, Ala, Val, Ile, Leu, Lys or Gly; the amino acid at position 154 is Ser, Trp, Thr, Asp or Glu; the amino acid at position 156 is Leu, Asp, Ile, Val, Asn, Glu or Gln; the amino acid at position 158 is Ser, Thr or Cys; the amino acid at position 159 is Val, Thr, Leu or Ile; the amino acid at position 162 is Ser, Thr, Gly or Ala; the amino acid at position 163 is Gly, Ala or deleted; the amino acid at position 164 is Phe or deleted; the amino acid at position 165 is Arg, Lys, Gly or Ala; the amino acid at position 166 is Ala, Arg, Met, Lys or Phe; the amino acid at position 167 is Val, Ile, Leu or His; the amino acid at position 168 is Ser, Thr, Gln or Asn; the amino acid at position 169 is Val, His, Ile, Leu, Ser or Thr; the amino acid at position 170 is Phe, Ile, Leu or Val; the amino acid at position 171 is Glu, Asn, Gln or Asp; the amino acid at position 172 is Val, Ala, Arg, Ile, Leu, Gly, Lys, Asp or Glu; the amino acid at position 175 is Ser, Arg, Thr, Lys or Trp; the amino acid at position 176 is Val, Leu or Ile; the amino acid at position 177 is Arg, Lys, Leu, Val or Ile; the amino acid at position 179 is Thr, Ile, Val, Leu or Ser; the amino acid at position 180 is Leu, Phe, Ile, Val, Ser or Thr; the amino acid at position 181 is Gly, Thr, Gln, Asn or Ser; the amino acid at position 182 is Ala, Leu, Phe, Val or Ile; the amino acid at position 183 is Thr, Ser, Ala or Gly; the amino acid at position 184 is Leu, Thr, Ser, Ile, Val, Lys or Arg; the amino acid at position 185 is Arg, Gly, Asp, Lys, Glu or Ala; the amino acid at position 186 is Pro, Val, Ile, Leu, Asn or Gln; the amino acid at position 187 is Asp, Thr, Glu or Ser; the amino acid at position 188 is His, Gly or Ala; the amino acid at position 189 is Ala, Arg, Pro, Lys, Gly or deleted; the amino acid at position 190 is Leu, Asn, Ile, Val, Gln or deleted; the amino acid at position 191 is Tyr or deleted; the amino acid at position 192 is Ser, Ile, Val, Leu, Thr or Asn; the amino acid at position 193 is Thr, Ser, Glu or Asp; the amino acid at position 194 is Thr or Ser; the amino acid at position 195 is Met or Thr; the amino acid at position 196 is Gln, His, Leu, Asn, Ile, Val, Thr or Ser; the amino acid at position 197 is Ala, Gly, Ile, Val or Leu; the amino acid at position 198 is Thr, Glu, Ser, Asp, Gly or Ala; the amino acid at position 199 is Pro, Lys or Arg; the amino acid at position 200 is Asn, Ser, Thr, Gln, Ala or Gly; the amino acid at position 201 is Ala, Leu, Glu, Ile, Asp or Trp; the amino acid at position 202 is Ser, Asp, Phe, Ile, Val, Thr, Glu or Leu; the amino acid at position 203 is His, Pro, Gly, Ala, Thr or Ser; the amino acid at position 204 is Ile, Trp, His, Leu, Val, Ala or Gly; the amino acid at position 205 is Ser, Asn, Leu, Val, Thr, Gln or Ile; the amino acid at position 206 is Ala, Gly, Asp, Tyr, Glu, Lys or Arg; the amino acid at position 207 is Phe, Val, Ile or Leu; the amino acid at position 208 is Asn, Ser, Pro, Gln, Thr, Val, Ile or Leu; the amino acid at position 210 is Arg, Asp, Glu, Lys, Ser or Tyr; the amino acid at position 211 is Ile, Ser, Leu, Val or Thr; the amino acid at position 212 is Val, Ala, Ile, Leu, Glu, Gly or Asp; the amino acid at position 214 is Pro, Lys or Arg; the amino acid at position 215 is Ser or Thr; the amino acid at position 217 is Tyr or Phe; the amino acid at position 218 is Arg, Lys, Thr or Ser; the amino acid at position 219 is Val, Ile, Leu or Ala; the amino acid at position 220 is Cys, Leu, Ile, Val, Thr or Ser; the amino acid at position 221 is Pro or His; the amino acid at position 222 is Leu, Arg, Lys, Ile, Val, Thr or Ser; the amino acid at position 224 is Asn, Gln, Thr or Ser; the amino acid at position 225 is Asp, Arg, Glu, Lys, Ser or Thr; the amino acid at position 226 is Thr, Ser, Gln or Asn; the amino acid at position 227 is Asp, Leu, Glu, Ile, Val or deleted; the amino acid at position 228 is Thr, Ser or deleted; the amino acid at position 229 is Tyr or deleted; the amino acid at position 230 is Leu, Ile, Val or deleted; the amino acid at position 231 is Gly, Ala or deleted; the amino acid at position 232 is Ile, Leu, Val or deleted; the amino acid at position 233 is Pro or deleted; the amino acid at position 234 is Ala, Pro, Gly or deleted; the amino acid at position 235 is Asp, Ile, Leu, Glu or Val; the amino acid at position 236 is Val, Ser, Ile, Leu, Thr, Asp or Glu; the amino acid at position 237 is Ala, Phe or Tyr; the amino acid at position 238 is Ala, Gly, Ser or Thr; the amino acid at position 239 is Val, Ser, Ile, Leu, Thr, Ala or Gly; the amino acid at position 240 is Leu, Val or Ile; the amino acid at position 243 is Asp or Glu; the amino acid at position 249 is Asn, Gln, Thr or Ser; the amino acid at position 252 is Leu, Ile, Val or Met; the amino acid at position 257 is Thr or Ser; the amino acid at position 259 is His, Ile, Val or Leu; the amino acid at position 266 is Ala, Ile, Leu or Val; the amino acid at position 267 is Cys, Ala or Gly; the amino acid at position 268 is His, Arg, Lys or Tyr; the amino acid at position 272 is Asp or Glu; the amino acid at position 273 is Val, Met, Ile or Leu; the amino acid at position 274 is Val, Ile, Leu or Met; the amino acid at position 278 is Gly or Ala; the amino acid at position 279 is Glu, Asp, Gly or Val; the amino acid at position 281 is Leu, Ile, Val, Gly or Ala; the amino acid at position 282 is Asn, Leu or Ile; the amino acid at position 285 is Asn, Gln, Thr or Ser; the amino acid at position 286 is Lys, Asp, Arg or Glu; the amino acid at position 287 is Leu, Ile or Val; the amino acid at position 290 is Pro, Gln, Asn, Lys or Arg; the amino acid at position 291 is Leu, Ile or Val; the amino acid at position 292 is Lys, Arg, Ile, Leu or Val; the amino acid at position 293 is Glu, Asp, Asn or Gln; the amino acid at position 294 is Ser, Asn, Thr, Gln, Arg or Lys; the amino acid at position 295 is Thr or Ser; the amino acid at position 296 is Gln, Asn or His; the amino acid at position 297 is Leu, Ile, Val or Met; the amino acid at position 300 is Ser or Thr; the amino acid at position 301 is Glu, Asp, Gly or Ala; the amino acid at position 302 is Ser, Pro, Thr, Gly or Ala; the amino acid at position 304 is Lys, Arg, Gln or Asn; the amino acid at position 313 is Val, Leu or Ile; the amino acid at position 314 is His, Glu, Asn, Asp or Gln; the amino acid at position 315 is Ala, Cys, Gly, Thr or Ser; the amino acid at position 316 is Ala, Ile, Leu or Val; the amino acid at position 317 is Met, Leu, Val or Ile; the amino acid at position 319 is Met, Leu, Val or Ile; the amino acid at position 320 is Val, Ile, Leu, Ala or Gly; the amino acid at position 321 is Arg, Lys or Pro; the amino acid at position 322 is Ile, Leu, Val or Phe; the amino acid at position 323 is Gly, Ile, Leu or Val; the amino acid at position 324 is Leu, Ile, Val, Thr or Ser; the amino acid at position 336 is Ser, Thr, Gln or Asn; the amino acid at position 339 is Asn, Lys, Gln or Arg; the amino acid at position 350 is Arg, Lys, Asn or Gln; the amino acid at position 351 is Glu or Asp; the amino acid at position 353 is Lys or Arg; the amino acid at position 354 is Gln, Asn, Lys or Arg; the amino acid at position 355 is Phe, Ile, Leu or Leu; the amino acid at position 356 is Lys or Arg; the amino acid at position 360 is Ile, Val, Leu, Gly or Ala; the amino acid at position 365 is Leu, Ile, Val or Phe; the amino acid at position 371 is or Glu or Asp; the amino acid at position 372 is or Lys or Arg; the amino acid at position 374 is Arg or Lys; the amino acid at position 376 is Phe, Ile, Val or Leu; the amino acid at position 378 is Glu or Asp; the amino acid at position 381 is Leu, Ile or Val; the amino acid at position 388 is Ala, Thr, Gly or Ser; the amino acid at position 395 is Arg or Lys; the amino acid at position 396 is Glu, Gln, Asp, Asn, Ala or Gly; the amino acid at position 399 is Asp, Gln, Glu or Asn; the amino acid at position 400 is Asn, Thr, Ser, Glu, Gln or Asp; the amino acid at position 401 is Thr, Ser, Gly or Ala; the amino acid at position 402 is Phe, Ile, Val or Leu; the amino acid at position 406 is Asp or Glu; the amino acid at position 408 is Leu, Ile, Val or Met; the amino acid at position 410 is Gly, Ile, Val, Ala or Leu; the amino acid at position 414 is Ala, Gly, Asp or Glu; the amino acid at position 416 is Ser, Asn, Thr, Gln, Glu or Asp; the amino acid at position 417 is Ser, Arg, Lys, Thr, Ala or Gly; the amino acid at position 423 is Lys, Arg, Asn or Gln; the amino acid at position 431 is Arg or Lys; the amino acid at position 432 is Gln, Asn, Asp or Glu; the amino acid at position 436 is Arg, Lys, Asp or Glu; the amino acid at position 440 is Asn, Gln, Lys or Arg; the amino acid at position 442 is Leu, Ile or Val; the amino acid at position 447 is Ser, Lys, Thr or Arg; the amino acid at position 448 is Ala, Gly, Thr or Ser; the amino acid at position 451 is Gln, Asn or Met; the amino acid at position 453 is Gly or Ala; the amino acid at position 455 is Ala, Leu, Ile or Val; the amino acid at position 457 is Leu, Ile or Val; the amino acid at position 467 is Val, Ile, Leu, Gly or Ala; the amino acid at position 471 is Gly or Ala; the amino acid at position 475 is Ser, Thr, Gln or Asn; the amino acid at position 483 is Gly or Ala; the amino acid at position 493 is Gln, Asn or Gly; the amino acid at position 504 is Val, Leu or Ile; the amino acid at position 506 is Asp, Glu or His; the amino acid at position 509 is Asp, Glu, Gln or Asn; the amino acid at position 510 is Ser, Thr, Gly or Ala; the amino acid at position 512 is Glu or Asp; the amino acid at position 515 is Gly, Ala, Thr or Ser; the amino acid at position 516 is Gln, Asn or His; the amino acid at position 517 is Ile, Val or Leu; the amino acid at position 519 is Asp, Asn, Glu, Gly or Gln; the amino acid at position 522 is Val, Glu, Pro, Ile, Leu or Asp; the amino acid at position 525 is Glu or Asp; the amino acid at position 526 is Leu, Ile, Val or Met; the amino acid at position 539 is Val, Leu or Ile; the amino acid at position 555 is Val, Leu, Ile or Ala; the amino acid at position 557 is Arg or Lys; the amino acid at position 563 is Val, Leu, Ile or Met; the amino acid at position 571 is Ser, Thr or Cys; the amino acid at position 575 is Val, Leu, Ile, Asp or Glu; the amino acid at position 577 is Met, Leu, Val or Ile; the amino acid at position 579 is Glu, Asp, Asn or Gln; the amino acid at position 583 is Asp or Glu; the amino acid at position 589 is Met, Ile, Val or Leu; the amino acid at position 590 is Met, Ile, Val or Leu; the amino acid at position 593 is Met, Leu, Val or Ile; the amino acid at position 595 is Arg, Lys, Asn or Gln; the amino acid at position 596 is Ser or Thr; the amino acid at position 597 is Gln, Asn or His; the amino acid at position 607 is Ala, Gly, Ile, Leu or Val; the amino acid at position 608 is Asp, Glu, Gln or Asn; the amino acid at position 612 is Tyr, His or Phe; the amino acid at position 617 is Thr, Ser, Leu, Val or Ile; the amino acid at position 618 is Gln, Asn or His; the amino acid at position 625 is Arg, Lys, Thr or Ser; the amino acid at position 626 is Met, Leu, Val or Ile; the amino acid at position 628 is Leu, Val or Ile; the amino acid at position 633 is Ile, Leu, Val or Met; the amino acid at position 634 is Leu, Ile, Val or Met; the amino acid at position 642 is Arg, Lys or Met; the amino acid at position 648 is Met, Ser or Thr; the amino acid at position 651 is Glu, Asp, Asn or Gln; the amino acid at position 654 is Thr, Val, Ser, Ile, Leu, Gly or Ala; the amino acid at position 658 is Gly, Lys, Ala or Arg; the amino acid at position 663 is Gly or Ala; the amino acid at position 664 is Asp, Glu, Gln or Asn; the amino acid at position 668 is Ala, Gly, Ser or Thr; the amino acid at position 669 is Gln, Asn or His; the amino acid at position 671 is Asn, Gln, Thr or Ser the amino acid at position 675 is Ile, Val, Ile, Thr or Ser; the amino acid at position 678 is Met, Ile, Ala, Leu, Ser or Thr; the amino acid at position 682 is Pro, Asn or Gln; the amino acid at position 683 is Ser, Thr or Pro; the amino acid at position 685 is Asp, Glu, Asp or Asn; the amino acid at position 694 is Asp, Glu, Ala or Gly; the amino acid at position 697 is Asn, Gln, Thr or Ser; the amino acid at position 704 is Glu, Asp, Ala or Gly; the amino acid at position 714 is Ala or Gly; the amino acid at position 721 is Ser, Thr or Phe; the amino acid at position 722 is Ser, Thr, Gln or Asn; the amino acid at position 724 is Ser or Thr; the amino acid at position 734 is His, Asn or Gln; the amino acid at position 736 is Val, Leu, Ile or Ala; the amino acid at position 737 is Lys, Arg, Asn or Gln; the amino acid at position 739 is Ala, Gly, Thr or Ser; the amino acid at position 740 is Ser, Thr or Met; the amino acid at position 741 is Gly, Ala, Gln or Asn; the amino acid at position 742 is Ile, Leu, Val, Ala or Gly; the amino acid at position 743 is Gly or deleted; the amino acid at position 745 is Gly, Ala, Glu or Asp; the amino acid at position 751 is Thr, Ser, Gly or Ala; the amino acid at position 753 is Gln, Asn, Lys or Arg; the amino acid at position 754 is Thr or Ser; the amino acid at position 756 is Thr, Ser, Leu, Val or Ile; the amino acid at position 757 is Val, Leu or Ile; the amino acid at position 766 is Ile, Leu or Val; the amino acid at position 773 is Asp or Glu; the amino acid at position 774 is Gln, Asn, Asp or Glu; the amino acid at position 776 is Leu, Ile, Val or Met; the amino acid at position 777 is Pro, Ser or Thr; the amino acid at position 782 is Ala, Asp, Glu, Ile, Leu or Val; the amino acid at position 786 is Tyr or Phe; the amino acid at position 787 is His, Asn or Gln; the amino acid at position 788 is Tyr or Met; the amino acid at position 789 is Ala, Lys or Arg; the amino acid at position 790 is Tyr or Thr; the amino acid at position 791 is Arg, Lys, Gly or Ala; the amino acid at position 792 is Leu, Ile, Val, Thr or Ser; the amino acid at position 796 is Asp or Glu; the amino acid at position 797 is Ser, Thr or Ala the amino acid at position 802 is Glu, Lys, Asp, Asn or Gln; the amino acid at position 806 is Gln, Asp, Glu, Asn or His; the amino acid at position 810 is Lys, Arg or Thr; the amino acid at position 819 is Arg, Lys or His; the amino acid at position 829 is Lys, Ser, Ala or Pro; the amino acid at position 832 is Ala, Lys, Arg, Asp or Glu; the amino acid at position 833 is Gly, Ala, Asp or Glu; the amino acid at position 842 is Leu, Ile, Val or Pro; the amino acid at position 847 is Gln, Asn, Asp or Glu; the amino acid at position 848 is Ile, Leu or Val; the amino acid at position 849 is Val, Leu, Ile, Gly or Ala; the amino acid at position 855 is Thr, Ser or Met; the amino acid at position 860 is Ile, Leu or Val; the amino acid at position 864 is His, Asn or Gln;

In some embodiments the nucleic acid molecule encodes a PtIP-83 polypeptide variant of SEQ ID NO: 1, wherein the amino acid at position 1 is Met or deleted; the amino acid at position 2 is Ala or deleted; the amino acid at position 3 is Leu, Val, Ile or deleted; the amino acid at position 4 is Val, Met, Ile or Leu; the amino acid at position 7 is Gly, Thr or Ser; the amino acid at position 8 is Lys, Arg, Ser or Thr; the amino acid at position 10 is Phe, Trp or Tyr; the amino acid at position 11 is Glu, Asp, Lys or Arg; the amino acid at position 18 is Met, Val, Leu or Ile; the amino acid at position 19 is Gly, Pro or Ala; the amino acid at position 20 is Val, Ile, Leu or deleted; the amino acid at position 21 is Leu, Ile or Val; the amino acid at position 23 is Arg, Lys, Asn or Gln; the amino acid at position 37 is Val, Ile or Leu; the amino acid at position 38 is Arg, Lys, Gln or Asn; the amino acid at position 40 is Ala, Gly, Thr or Ser; the amino acid at position 43 is Asn, Gln, Glu or Asp; the amino acid at position 45 is Gly or Ala; the amino acid at position 46 is Gln, Asp, Asn or Glu; the amino acid at position 48 is Glu, Asp, Pro, Ile, Leu or Val; the amino acid at position 51 is Glu, Asp, Ala or Gly; the amino acid at position 52 is Lys, Arg, Ser or Thr; the amino acid at position 53 is Val, Ala, Cys or Thr; the amino acid at position 54 is Lys, Ala, Cys, Asp, Glu, Gly, His, Ile, Leu, Met, Asn, Gln, Arg, Ser or Thr; the amino acid at position 55 is Arg, Ala, Asp, Glu, Phe, Gly, His, Lys, Leu, Met, Asn, Gln, Ser, Thr, Val, Trp or Tyr; the amino acid at position 56 is Leu, Glu, Phe, Ile, Met, Thr or Val; the amino acid at position 57 is Tyr, Cys, Ile, Leu, Met, Thr or Val; the amino acid at position 58 is Val, Cys, Ile or Leu; the amino acid at position 59 is Phe, Leu, Met, Val or Tyr; the amino acid at position 60 is Ala, Cys, Gly, Ser, Thr or Val; the amino acid at position 61 is Asp, Glu, His or Ser; the amino acid at position 62 is Val, Ala, Cys, Ile, Leu or Thr; the amino acid at position 63 is Val, Ala, Cys, Ile, Leu, Met or Thr; the amino acid at position 64 is Glu, Ala, Cys, Phe, Gly, His, Ile, Leu, Met, Asn, Gln, Arg, Ser, Thr, Val, Trp or Tyr; the amino acid at position 65 is Leu, Ala, Cys, Phe, His, Ile, Met, Asn, Gln, Thr, Val or Trp; the amino acid at position 66 is Pro, Asp, Gly, Met, Gln or Arg; the amino acid at position 67 is Val, Pro, Ile, Leu, Ser or Thr; the amino acid at position 68 is Val, Arg, Phe, Ile, Leu, Lys or Gly; the amino acid at position 69 is Glu, Ala, Asp, Gly, Arg or Lys; the amino acid at position 70 is Trp, Thr, His, Tyr, Lys or Arg; the amino acid at position 71 is Arg, Pro, Lys or deleted; the amino acid at position 72 is Trp, Asp, Leu, Ile, Val, Glu or deleted; the amino acid at position 73 is Pro, Gln, Asn, His or deleted; the amino acid at position 74 is Pro, Met, Ser or Thr; the amino acid at position 75 is Gln, His, Asn, Lys or Arg; the amino acid at position 76 is Ile, Met, Val or Leu; the amino acid at position 84 is Ile, Leu or Val; the amino acid at position 91 is Trp or Phe; the amino acid at position 93 is Thr, Ser, Leu, Val or Ile; the amino acid at position 94 is Asp, Glu, Ala or Gly; the amino acid at position 96 is Arg, Lys, Thr or Ser; the amino acid at position 97 is Gln, Phe, Asn, Lys or Arg; the amino acid at position 98 is Ser, Thr or deleted; the amino acid at position 99 is Asp, Glu, Gly or Ala; the amino acid at position 100 is Thr, Ser, Gly or Ala; the amino acid at position 101 is Glu, Thr, Asp, Ser or Trp the amino acid at position 103 is His, Arg, Lys, Glu or Gln; the amino acid at position 105 is Thr, Ser or Pro; the amino acid at position 108 is Lys, Arg, Asn, Asp, Gln or Glu; the amino acid at position 109 is Leu, Ile or Val; the amino acid at position 111 is Ala, Ser or Thr; the amino acid at position 112 is Ile, Arg, Thr, Leu, Val, Lys, Ser or deleted; the amino acid at position 113 is Gln, Ala, Gly, Asn or deleted; the amino acid at position 114 is Arg, Glu, Lys, Asp or Ile; the amino acid at position 115 is Glu, Asp, Asn or Gln; the amino acid at position 116 is Glu, Asn, Gln, Asp, Lys or Arg; the amino acid at position 117 is Asn, Val, Tyr, Ile, Leu, Gln, Trp or Phe; the amino acid at position 118 is Arg or Lys; the amino acid at position 119 is Trp, Thr or Ser; the amino acid at position 122 is Thr, Lys, Ser, Arg or Ala; the amino acid at position 124 is Ala, Gly, Ser or Thr; the amino acid at position 126 is Gly, Ala, Glu or Asp; the amino acid at position 127 is Met, Gly or Ala; the amino acid at position 128 is Asn, Gln, Arg or Lys; the amino acid at position 131 is Val, Ile, Leu, Ser or Thr; the amino acid at position 133 is Ile, Leu or Val; the amino acid at position 134 is His or Tyr; the amino acid at position 135 is Ala or Gly; the amino acid at position 137 is Glu, Asp, Arg or Lys; the amino acid at position 139 is Gln, Asn, Asp or Glu; the amino acid at position 140 is Val, Arg, Ile, Lys or Leu; the amino acid at position 141 is Gly, Ala, Thr or Ser; the amino acid at position 142 is Val, Ile, Leu or Pro; the amino acid at position 144 is Thr, Leu, Phe, Ile, Val or Tyr; the amino acid at position 145 is Met, Pro, Gln or Asn; the amino acid at position 146 is Ser, Gly, Thr, Ala, Gln or Asn; the amino acid at position 147 is Trp, Gln, Tyr or Asn; the amino acid at position 148 is Ser, Ala, Thr, Gly or Pro; the amino acid at position 149 is Ser, Thr or deleted; the amino acid at position 150 is Val, Ile, Leu or Tyr; the amino acid at position 152 is Arg, Ala, Val, Ile, Leu, Lys or Gly; the amino acid at position 154 is Ser, Trp, Thr, Asp or Glu; the amino acid at position 156 is Leu, Asp, Ile, Val, Asn, Glu or Gln; the amino acid at position 158 is Ser, Thr or Cys; the amino acid at position 159 is Val, Thr, Leu or Ile; the amino acid at position 162 is Ser, Thr, Gly or Ala; the amino acid at position 163 is Gly, Ala or deleted; the amino acid at position 164 is Phe or deleted; the amino acid at position 165 is Arg, Lys, Gly or Ala; the amino acid at position 166 is Ala, Arg, Met, Lys or Phe; the amino acid at position 167 is Val, Ile, Leu or His; the amino acid at position 168 is Ser, Thr, Gln or Asn; the amino acid at position 169 is Val, His, Ile, Leu, Ser or Thr; the amino acid at position 170 is Phe, Ile, Leu or Val; the amino acid at position 171 is Glu, Asn, Gln or Asp; the amino acid at position 172 is Val, Ala, Arg, Ile, Leu, Gly, Lys, Asp or Glu; the amino acid at position 175 is Ser, Arg, Thr, Lys or Trp; the amino acid at position 176 is Val, Leu or Ile; the amino acid at position 177 is Arg, Lys, Leu, Val or Ile; the amino acid at position 179 is Thr, Ile, Val, Leu or Ser; the amino acid at position 180 is Leu, Phe, Ile, Val, Ser or Thr; the amino acid at position 181 is Gly, Thr, Gln, Asn or Ser; the amino acid at position 182 is Ala, Leu, Phe, Val or Ile; the amino acid at position 183 is Thr, Ser, Ala or Gly; the amino acid at position 184 is Leu, Thr, Ser, Ile, Val, Lys or Arg; the amino acid at position 185 is Arg, Gly, Asp, Lys, Glu or Ala; the amino acid at position 186 is Pro, Val, Ile, Leu, Asn or Gln; the amino acid at position 187 is Asp, Thr, Glu or Ser; the amino acid at position 188 is His, Gly or Ala; the amino acid at position 189 is Ala, Arg, Pro, Lys, Gly or deleted; the amino acid at position 190 is Leu, Asn, Ile, Val, Gln or deleted; the amino acid at position 191 is Tyr or deleted; the amino acid at position 192 is Ser, Ile, Val, Leu, Thr or Asn; the amino acid at position 193 is Thr, Ser, Glu or Asp; the amino acid at position 194 is Thr or Ser; the amino acid at position 195 is Met or Thr; the amino acid at position 196 is Gln, His, Leu, Asn, Ile, Val, Thr or Ser; the amino acid at position 197 is Ala, Gly, Ile, Val or Leu; the amino acid at position 198 is Thr, Glu, Ser, Asp, Gly or Ala; the amino acid at position 199 is Pro, Lys or Arg; the amino acid at position 200 is Asn, Ser, Thr, Gln, Ala or Gly; the amino acid at position 201 is Ala, Leu, Glu, Ile, Asp or Trp; the amino acid at position 202 is Ser, Asp, Phe, Ile, Val, Thr, Glu or Leu; the amino acid at position 203 is His, Pro, Gly, Ala, Thr or Ser; the amino acid at position 204 is Ile, Trp, His, Leu, Val, Ala or Gly; the amino acid at position 205 is Ser, Asn, Leu, Val, Thr, Gln or Ile; the amino acid at position 206 is Ala, Gly, Asp, Tyr, Glu, Lys or Arg; the amino acid at position 207 is Phe, Val, Ile or Leu; the amino acid at position 208 is Asn, Ser, Pro, Gln, Thr, Val, Ile or Leu; the amino acid at position 210 is Arg, Asp, Glu, Lys, Ser or Tyr; the amino acid at position 211 is Ile, Ser, Leu, Val or Thr; the amino acid at position 212 is Val, Ala, Ile, Leu, Glu, Gly or Asp; the amino acid at position 214 is Pro, Lys or Arg; the amino acid at position 215 is Ser or Thr; the amino acid at position 217 is Tyr or Phe; the amino acid at position 218 is Arg, Lys, Thr or Ser; the amino acid at position 219 is Val, Ile, Leu or Ala; the amino acid at position 220 is Cys, Leu, Ile, Val, Thr or Ser; the amino acid at position 221 is Pro or His; the amino acid at position 222 is Leu, Arg, Lys, Ile, Val, Thr or Ser; the amino acid at position 224 is Asn, Gln, Thr or Ser; the amino acid at position 225 is Asp, Arg, Ala, Lys, Ser or Thr; the amino acid at position 226 is Thr, Ser, Gln or Asn; the amino acid at position 227 is Asp, Leu, Glu, Ile, Val or deleted; the amino acid at position 228 is Thr, Ser or deleted; the amino acid at position 229 is Tyr or deleted; the amino acid at position 230 is Leu, Ile, Val or deleted; the amino acid at position 231 is Gly, Ala or deleted; the amino acid at position 232 is Ile, Leu, Val or deleted; the amino acid at position 233 is Pro or deleted; the amino acid at position 234 is Ala, Pro, Gly or deleted; the amino acid at position 235 is Asp, Ile, Leu, Glu or Val; the amino acid at position 236 is Val, Ser, Ile, Leu, Thr, Asp or Glu; the amino acid at position 237 is Ala, Phe or Tyr; the amino acid at position 238 is Ala, Gly, Ser or Thr; the amino acid at position 239 is Val, Ser, Ile, Leu, Thr, Ala or Gly; the amino acid at position 240 is Leu, Val or Ile; the amino acid at position 243 is Asp or Glu; the amino acid at position 249 is Asn, Gln, Thr or Ser; the amino acid at position 252 is Leu, Ile, Val or Met; the amino acid at position 257 is Thr or Ser; the amino acid at position 259 is His, Ile, Val or Leu; the amino acid at position 266 is Ala, Ile, Leu or Val; the amino acid at position 267 is Cys, Ala or Gly; the amino acid at position 268 is His, Arg, Lys or Tyr; the amino acid at position 272 is Asp or Glu; the amino acid at position 273 is Val, Met, Ile or Leu; the amino acid at position 274 is Val, Ile, Leu or Met; the amino acid at position 278 is Gly or Ala; the amino acid at position 279 is Glu, Asp, Gly or Val; the amino acid at position 281 is Leu, Ile, Val, Gly or Ala; the amino acid at position 282 is Asn, Leu or Ile; the amino acid at position 285 is Asn, Gln, Thr or Ser; the amino acid at position 286 is Lys, Asp, Arg or Glu; the amino acid at position 287 is Leu, Ile or Val; the amino acid at position 290 is Pro, Gln, Asn, Lys or Arg; the amino acid at position 291 is Leu, Ile or Val; the amino acid at position 292 is Lys, Arg, Ile, Leu or Val; the amino acid at position 293 is Glu, Asp, Asn or Gln; the amino acid at position 294 is Ser, Asn, Thr, Gln, Arg or Lys; the amino acid at position 295 is Thr or Ser; the amino acid at position 296 is Gln, Asn or His; the amino acid at position 297 is Leu, Ile, Val or Met; the amino acid at position 300 is Ser or Thr; the amino acid at position 301 is Glu, Asp, Gly or Ala; the amino acid at position 302 is Ser, Pro, Thr, Gly or Ala; the amino acid at position 304 is Lys, Arg, Gln or Asn; the amino acid at position 313 is Val, Leu or Ile; the amino acid at position 314 is His, Glu, Asn, Asp or Gln; the amino acid at position 315 is Ala, Cys, Gly, Thr or Ser; the amino acid at position 316 is Ala, Ile, Leu or Val; the amino acid at position 317 is Met, Leu, Val or Ile; the amino acid at position 319 is Met, Leu, Val or Ile; the amino acid at position 320 is Val, Ile, Leu, Ala or Gly; the amino acid at position 321 is Arg, Lys or Pro; the amino acid at position 322 is Ile, Leu, Val or Phe; the amino acid at position 323 is Gly, Ile, Leu or Val; the amino acid at position 324 is Leu, Ile, Val, Thr or Ser; the amino acid at position 336 is Ser, Thr, Gln or Asn; the amino acid at position 339 is Asn, Lys, Gln or Arg; the amino acid at position 350 is Arg, Lys, Asn or Gln; the amino acid at position 351 is Glu or Asp; the amino acid at position 353 is Lys or Arg; the amino acid at position 354 is Gln, Asn, Lys or Arg; the amino acid at position 355 is Phe, Ile, Leu or Leu; the amino acid at position 356 is Lys or Arg; the amino acid at position 360 is Ile, Val, Leu, Gly or Ala; the amino acid at position 363 is Gln, Ala, Cys, Glu, Phe, Gly, His, Lys, Leu, Asn, Arg, Ser, Thr, Val or Trp; the amino acid at position 364 is Ile, Ala, Cys, Glu, Phe, His, Lys, Leu, Met, Asn, Gln, Ser, Thr, Val, Trp or Tyr; the amino acid at position 365 is Leu, Ala, Glu, Phe, Gly, His, Ile, Lys, Met, Asn, Arg, Val, Trp or Tyr; the amino acid at position 366 is Gly, Ala, Cys, Phe, His, Ile, Lys, Leu, Met, Asn, Ser, Thr or Val; the amino acid at position 367 is Ser, Ala, Cys, Asp, Glu, Phe, Gly, His, Ile, Leu, Met, Asn, Pro, Gln, Arg, Thr, Val or Trp; the amino acid at position 368 is Tyr, Ala, Cys, Asp, Glu, Phe, Gly, His, Ile, Lys, Leu, Met, Asn, Pro, Gln, Arg, Ser, Thr, Val or Trp; the amino acid at position 369 is Leu, Ala, Cys, Asp, Phe, Gly, Ile, Met, Thr or Val; the amino acid at position 370 is Leu, Ala, Cys, Asp, Glu, Phe, Gly, His, Ile, Lys, Met, Gln, Arg, Ser, Thr, Val, Trp or Tyr; the amino acid at position 371 is Gln, Ala, Cys, Asp, Glu, Phe, Gly, Ile, Lys, Leu, Asn, Arg, Ser, Thr, Val or Trp; the amino acid at position 372 is Gln, Ala, Cys, Asp, Phe, Gly, His, Ile, Leu, Asn, Arg, Ser, Val or Tyr; the amino acid at position 373 is Asn, Ala, Cys, Asp, Phe, Gly, His, Ile, Lys, Gln, Ser, Thr, Val or Trp; the amino acid at position 374 is Arg or Lys; the amino acid at position 376 is Phe, Ile, Val or Leu; the amino acid at position 378 is Glu or Asp; the amino acid at position 381 is Leu, Ile or Val; the amino acid at position 388 is Ala, Thr, Gly or Ser; the amino acid at position 395 is Arg or Lys; the amino acid at position 396 is Glu, Gln, Asp, Asn, Ala or Gly; the amino acid at position 399 is Asp, Gln, Glu or Asn; the amino acid at position 400 is Asn, Thr, Ser, Glu, Gln or Asp; the amino acid at position 401 is Thr, Ser, Gly or Ala; the amino acid at position 402 is Phe, Ile, Val or Leu; the amino acid at position 406 is Asp or Glu; the amino acid at position 408 is Leu, Ile, Val or Met; the amino acid at position 410 is Gly, Ile, Val, Ala or Leu; the amino acid at position 414 is Ala, Gly, Asp or Glu; the amino acid at position 416 is Ser, Asn, Thr, Gln, Glu or Asp; the amino acid at position 417 is Ser, Arg, Lys, Thr, Ala or Gly; the amino acid at position 423 is Lys, Arg, Asn or Gln; the amino acid at position 431 is Arg or Lys; the amino acid at position 432 is Gln, Asn, Asp or Glu; the amino acid at position 436 is Arg, Lys, Asp or Glu; the amino acid at position 440 is Asn, Gln, Lys or Arg; the amino acid at position 442 is Leu, Ile or Val; the amino acid at position 447 is Ser, Lys, Thr or Arg; the amino acid at position 448 is Ala, Gly, Thr or Ser; the amino acid at position 451 is Gln, Asn or Met; the amino acid at position 453 is Gly or Ala; the amino acid at position 455 is Ala, Leu, Ile or Val; the amino acid at position 457 is Leu, Ile or Val; the amino acid at position 467 is Val, Ile, Leu, Gly or Ala; the amino acid at position 471 is Gly or Ala; the amino acid at position 475 is Ser, Thr, Gln or Asn; the amino acid at position 483 is Gly or Ala; the amino acid at position 493 is Gln, Asn or Gly; the amino acid at position 504 is Val, Leu or Ile; the amino acid at position 506 is Asp, Glu or His; the amino acid at position 509 is Asp, Glu, Gln or Asn; the amino acid at position 510 is Ser, Thr, Gly or Ala; the amino acid at position 512 is Glu or Asp; the amino acid at position 515 is Gly, Ala, Thr or Ser; the amino acid at position 516 is Gln, Asn or His; the amino acid at position 517 is Ile, Val or Leu; the amino acid at position 519 is Asp, Asn, Glu, Gly or Gln; the amino acid at position 522 is Val, Glu, Pro, Ile, Leu or Asp; the amino acid at position 525 is Glu or Asp; the amino acid at position 526 is Leu, Ile, Val or Met; the amino acid at position 539 is Val, Leu or Ile; the amino acid at position 555 is Val, Leu, Ile or Ala; the amino acid at position 556 is Trp, Phe, Thr or Tyr; the amino acid at position 557 is Arg, Cys, Asp, Gly, His, Ile, Lys, Leu, Met, Asn, Pro, Gln, Ser, Thr, Val, Trp or Tyr; the amino acid at position 558 is Ala, Cys, Asp, Phe, Gly, His, Ile, Lys, Leu, Asn, Pro, Gln, Arg, Ser, Val, Trp or Tyr; the amino acid at position 559 is Lys, Ala, Cys, Phe, Gly, His, Ile, Leu, Asn, Gln, Arg, Ser, Thr, Val or Tyr; the amino acid at position 560 is Cys, Ala, Phe, Gly, Ile, Met, Asn, Arg, Ser, Thr or Val; the amino acid at position 561 is Lys, Ala, Cys, Asp, Glu, Phe, Gly, His, Ile, Leu, Met, Asn, Arg, Ser, Thr, Val or Tyr; the amino acid at position 562 is Asn, Cys, Asp, Glu, Gly, His, Leu, Met, Arg, Ser, Thr, Val or Tyr; the amino acid at position 563 is Val, Ala, Cys, Asp, Phe, His, Ile, Leu, Met, Asn, Gln, Thr or Trp; the amino acid at position 564 is Ala, Cys, Gly, Met, Gln, Ser, Thr, Val, Trp or Tyr; the amino acid at position 571 is Ser, Thr or Cys; the amino acid at position 575 is Val, Leu, Ile, Asp or Glu; the amino acid at position 577 is Met, Leu, Val or Ile; the amino acid at position 579 is Glu, Asp, Asn or Gln; the amino acid at position 583 is Asp or Glu; the amino acid at position 589 is Met, Ile, Val or Leu; the amino acid at position 590 is Met, Ile, Val or Leu; the amino acid at position 593 is Met, Leu, Val or Ile; the amino acid at position 595 is Arg, Lys, Asn or Gln; the amino acid at position 596 is Ser or Thr; the amino acid at position 597 is Gln, Asn or His; the amino acid at position 607 is Ala, Gly, Ile, Leu or Val; the amino acid at position 608 is Asp, Glu, Gln or Asn; the amino acid at position 612 is Tyr, His or Phe; the amino acid at position 617 is Thr, Ser, Leu, Val or Ile; the amino acid at position 618 is Gln, Asn or His; the amino acid at position 625 is Arg, Lys, Thr or Ser; the amino acid at position 626 is Met, Leu, Val or Ile; the amino acid at position 628 is Leu, Val or Ile; the amino acid at position 633 is Ile, Leu, Val or Met; the amino acid at position 634 is Leu, Ile, Val or Met; the amino acid at position 642 is Arg, Lys or Met; the amino acid at position 646 is Leu, Ala, Cys, Gly, Ile, Met, Asn, Gln, Ser, Thr or Val; the amino acid at position 647 is Leu, Asp, Gly, Met, Asn, Gln or Thr; the amino acid at position 648 is Met, Ala, Cys, Asp, Glu, Phe, Gly, His, Lys, Leu, Asn, Pro, Gln, Arg, Ser, Thr, Val, Trp or Tyr; the amino acid at position 649 is Pro, Ala, Cys, Asp, Glu, Phe, Gly, His, Lys, Met, Asn, Gln, Arg, Ser, Thr, Trp or Tyr; the amino acid at position 650 is Thr, Ala, Cys, Asp, Phe, Gly, His, Ile, Lys, Leu, Met, Pro, Gln, Arg, Ser, Val or Tyr; the amino acid at position 651 is Glu, Ala, Cys, Asp, Gly, His, Ile, Leu, Met, Asn, Pro, Gln, Arg, Ser, Thr, Val or Tyr; the amino acid at position 652 is Leu, Cys, Phe, Ile, Lys, Met, Pro, Arg, Ser, Thr or Val; the amino acid at position 653 is Thr, Cys, Asp, Glu, Phe, Gly, His, Ile, Lys, Leu, Pro, Arg, Ser, Val or Trp; the amino acid at position 654 is Thr, Ala, Cys, Phe, Ile, Lys, Leu, Met, Pro, Arg, Ser, Val, Trp or Tyr; the amino acid at position 655 is Trp, Phe or Tyr; the amino acid at position 658 is Gly, Lys, Ala or Arg; the amino acid at position 663 is Gly or Ala; the amino acid at position 664 is Asp, Glu, Gln or Asn; the amino acid at position 668 is Ala, Gly, Ser or Thr; the amino acid at position 669 is Gln, Asn or His; the amino acid at position 671 is Asn, Gln, Thr or Ser the amino acid at position 675 is Ile, Val, Ile, Thr or Ser; the amino acid at position 678 is Met, Ile, Ala, Leu, Ser or Thr; the amino acid at position 682 is Pro, Asn or Gln; the amino acid at position 683 is Ser, Thr or Pro; the amino acid at position 685 is Asp, Glu, Asp or Asn; the amino acid at position 694 is Asp, Glu, Ala or Gly; the amino acid at position 697 is Asn, Gln, Thr or Ser; the amino acid at position 704 is Glu, Asp, Ala or Gly; the amino acid at position 714 is Ala or Gly; the amino acid at position 721 is Ser, Thr or Phe; the amino acid at position 722 is Ser, Thr, Gln or Asn; the amino acid at position 724 is Ser or Thr; the amino acid at position 734 is His, Asn or Gln; the amino acid at position 736 is Val, Leu, Ile or Ala; the amino acid at position 737 is Lys, Arg, Asn or Gln; the amino acid at position 739 is Ala, Gly, Thr or Ser; the amino acid at position 740 is Ser, Thr or Met; the amino acid at position 741 is Gly, Ala, Gln or Asn; the amino acid at position 742 is Ile, Leu, Val, Ala or Gly; the amino acid at position 743 is Gly or deleted; the amino acid at position 745 is Gly, Ala, Glu or Asp; the amino acid at position 751 is Thr, Ser, Gly or Ala; the amino acid at position 753 is Gln, Asn, Lys or Arg; the amino acid at position 754 is Thr or Ser; the amino acid at position 756 is Thr, Ser, Leu, Val or Ile; the amino acid at position 757 is Val, Leu or Ile; the amino acid at position 766 is Ile, Leu or Val; the amino acid at position 771 is Arg, Ala, Asp, Glu, Phe, Gly, His, Ile, Lys, Leu, Asn, Ser, Thr, Val, Trp or Tyr; the amino acid at position 772 is Arg, Ala, Cys, Asp, Glu, Phe, Gly, His, Ile, Lys, Leu, Met, Pro, Gln, Ser, Thr, Val, Trp or Tyr; the amino acid at position 773 is Asp, Ala, Glu, Phe, Gly, His, Ile, Lys, Leu, Met, Asn, Gln, Arg, Ser, Thr, Val, Trp or Tyr; the amino acid at position 774 is Gln, Ala, Asp, Gly, His, Ile, Lys, Leu, Met, Asn, Pro, Arg, Ser, Thr, Val, Trp or Tyr; the amino acid at position 775 is Val, Ala, Cys, Asp, Glu, Gly, His, Ile, Asn, Pro, Gln, Arg, Ser, Thr or Tyr; the amino acid at position 776 is Leu, Ala, Cys, Asp, Glu, Phe, Gly, His, Ile, Lys, Asn, Pro, Gln, Arg, Ser, Thr, Val or Tyr; the amino acid at position 777 is Pro, Ala, Cys, Asp, Glu, Phe, Gly, His, Lys, Leu, Met, Asn, Gln, Ser, Thr, Val, Trp or Tyr; the amino acid at position 778 is Phe, Ala, His, Ile, Leu, Met, Asn, Gln, Ser, Val, Trp or Tyr; the amino acid at position 779 is Gln, Ala, Cys, Asp, Glu, Gly, His, Lys, Leu, Asn, Pro, Arg, Ser, Thr or Val; the amino acid at position 780 is Ala, Cys, Asn, Pro, Gln or Ser; the amino acid at position 781 is Ala, Cys, Asp, Glu, Phe, Gly, His, Ile, Asn, Gln, Arg, Ser, Thr, Val, Trp or Tyr; the amino acid at position 782 is Ala, Cys, Asp, Glu, Phe, Gly, His, Ile, Lys, Met, Pro, Gln, Arg, Ser, Thr, Val, Trp or Tyr; the amino acid at position 783 is Pro, Ala, Cys, Asp, Glu, Gly, His, Asn, Gln, Arg, Ser, Thr or Val; the amino acid at position 784 is Leu, Ala, Glu, Phe, His, Ile, Lys, Met, Asn, Pro, Gln, Ser, Thr, Val or Trp; the amino acid at position 785 is Asn, Ala, Cys, Glu, Phe, Gly, His, Ile, Lys, Leu, Met, Gln, Arg, Ser, Thr, Val, Trp or Tyr; the amino acid at position 786 is Tyr, Phe, Ile, Leu or Trp; the amino acid at position 787 is His, Asn or Gln; the amino acid at position 788 is Tyr or Met; the amino acid at position 789 is Ala, Lys or Arg; the amino acid at position 790 is Tyr or Thr; the amino acid at position 791 is Arg, Lys, Gly or Ala; the amino acid at position 792 is Leu, Ile, Val, Thr or Ser; the amino acid at position 796 is Asp or Glu; the amino acid at position 797 is Ser, Thr or Ala the amino acid at position 802 is Glu, Lys, Asp, Asn or Gln; the amino acid at position 806 is Gln, Asp, Glu, Asn or His; the amino acid at position 810 is Lys, Arg or Thr; the amino acid at position 819 is Arg, Lys or His; the amino acid at position 829 is Lys, Ser, Ala or Pro; the amino acid at position 832 is Ala, Lys, Arg, Asp or Glu; the amino acid at position 833 is Gly, Ala, Asp or Glu; the amino acid at position 842 is Leu, Ile, Val or Pro; the amino acid at position 847 is Gln, Asn, Asp or Glu; the amino acid at position 848 is Ile, Leu or Val; the amino acid at position 849 is Val, Leu, Ile, Gly or Ala; the amino acid at position 855 is Thr, Ser or Met; the amino acid at position 860 is Ile, Leu or Val; and the amino acid at position 864 is His, Asn or Gln.

In some embodiments the nucleic acid molecule encoding the PtIP-83 polypeptide is derived from a fern species in the Division *Pteridophyta*. The phylogeny of ferns as used herein is based on the classification for extant ferns by A. R. Smith et al, *TAXON*, 55:705-731 (2006). The consensus phylogeny based on the classification by A. R. Smith is shown in FIG. 1. Other phylogenic classifications of extant ferns are known to one skilled in the art. Additional information on the phylogeny of ferns can be found at mobot.org/MOBOT/research/APweb/ (which can be accessed using the "www" prefix) and Schuettpelz E. and Pryer K. M., *TAXON* 56: 1037-1050 (2007) based on three plastid genes. Additional fern and other primitive plant species can be found at homepages.caverock.net.nz/~bj/fern/list.htm (which can be accessed using the http:// prefix).

In some embodiments the nucleic acid molecule encoding the PtIP-83 polypeptide is derived from a fern species in the Class Psilotopsida. In some embodiments the nucleic acid molecule encoding the PtIP-83 polypeptide is derived from a fern species in the Class Psilotopsida, Order Psilotales. In some embodiments the nucleic acid molecule encoding PtIP-83 polypeptide is derived from a fern species in the Class Psilotopsida, Order Ophioglossales. In some embodiments the nucleic acid molecule encoding the PtIP-83 polypeptide is derived from a fern species in the Class Psilotopsida, Order Ophioglossales, Family Psilotaceae. In some embodiments the nucleic acid molecule encoding the PtIP-83 polypeptide is derived from a fern species in the Class Psilotopsida, Order Ophioglossales Family Ophioglossaceae. In some embodiments the nucleic acid molecule encoding the PtIP-83 polypeptide is derived from a fern species in the Genus *Ophioglossum* L., *Botrychium*, *Botrypus*, *Helminthostachys*, *Ophioderma*, *Cheiroglossa*, *Sceptridium* or *Mankyua*.

In some embodiments the nucleic acid molecule encoding the PtIP-83 polypeptide is derived from a species in the Class Polypodiopsida/Pteridopsida. In some embodiments the nucleic acid molecule encoding the PtIP-83 polypeptide is derived from a fern species in the Order Osmundales (royal ferns); Family Osmundaceae. In some embodiments the nucleic acid molecule encoding the PtIP-83 polypeptide is derived from a fern species in the Order Hymenophyllales; Family Hymenophyllaceae. In some embodiments the nucleic acid molecule encoding the PtIP-83 polypeptide is derived from a fern species in the Order Gleicheniales; Family Gleicheniaceae, Family Dipteridaceae or Family Matoniaceae. In some embodiments the nucleic acid molecule encoding the PtIP-83 polypeptide is derived from a fern species in the Order Schizaeales; Family Lygodiaceae, Family Anemiaceae or Family Schizaeaceae. In some embodiments the nucleic acid encoding the PtIP-83 polypeptide is derived from a fern species in the Order Schizaeales; Family Schizaeaceae, Genus *Lygodium* selected from but not limited to *Lygodium articulatum, Lygodium circinatum, Lygodium conforme, Lygodium cubense, Lygodium digitatum, Lygodium flexuosum, Lygodium heterodoxum, Lygodium japonicum, Lygodium kerstenii, Lygodium lanceolatum, Lygodium longifolium, Lygodium merrilii, Lygodium micans, Lygodium microphyllum, Lygodium microstachyum, Lygodium oligostachyum, Lygodium palmatum, Lygodium polystachyum, Lygodium radiatum, Lygodium reticulatum, Lygodium salicifolium, Lygodium scandens, Lygodium smithianum, Lygodium subareolatum, Lygodium trifurcatum, Lygodium venustum, Lygodium versteeghii, Lygodium volubile*, and *Lygodium yunnanense*. In some embodiments the nucleic acid molecule encoding the PtIP-83 polypeptide is derived from a fern species in the Order Salviniales; Family Marsileaceae or Family Salviniaceae. In some embodiments the nucleic acid molecule encoding the PtIP-83 polypeptide is derived from a fern species in the Order Cyatheales; Family Thyrsopteridaceae, Family Loxsomataceae, Family Culcitaceae, Family Plagiogyriaceae, Family Cibotiaceae, Family Cyatheaceae, Family Dicksoniaceae or Family Metaxyaceae.

In some embodiments the nucleic acid molecule encoding the PtIP-83 polypeptide is derived from a fern species in the Order Polypodiales; Family Lindsaeaceae, Family Saccolomataceae, Family Cystodiaceae, Family Dennstaedtiaceae, Family Pteridaceae, Family Aspleniaceae, Family Thelypteridaceae, Family Woodsiaceae, Family Onocleaceae, Family Blechnaceae, Family Dryopteridaceae, Family Lomariopsidaceae, Family Tectariaceae, Family Oleandraceae, Family Davalliaceae or Family Polypodiaceae.

In some embodiments the nucleic acid molecule encoding the PtIP-83 polypeptide is derived from a fern species in the Order Polypodiales, Family Pteridaceae, Genus *Adiantaceae* selected from but not limited to *Adiantum aethiopicum, Adiantum aleuticum, Adiantum bonatianum, Adiantum cajennense, Adiantum capillus-junonis, Adiantum capillus-veneris, Adiantum caudatum, Adiantum chienii, Adiantum chilense, Adiantum cuneatum, Adiantum cunninghamii, Adiantum davidii, Adiantum diaphanum, Adiantum edentulum, Adiantum edgeworthii, Adiantum excisum, Adiantum fengianum, Adiantum fimbriatum, Adiantum flabellulatum, Adiantum formosanum, Adiantum formosum, Adiantum fulvum, Adiantum gravesii, Adiantum hispidulum, Adiantum induratum, Adiantum jordanii, Adiantum juxtapositum, Adiantum latifolium, Adiantum leveillei, Adiantum lianxianense, Adiantum malesianum, Adiantum mariesii, Adiantum monochlamys, Adiantum myriosorum, Adiantum obliquum, Adiantum ogasawarense, Adiantum pedatum, Adiantum pentadactylon, Adiantum peruvianum, Adiantum philippense, Adiantum princeps, Adiantum pubescens, Adiantum raddianum, Adiantum reniforme, Adiantum roborowskii, Adiantum serratodentatum, Adiantum sinicum, Adiantum soboliferum, Adiantum subcordatum, Adiantum tenerum, Adiantum terminatum, Adiantum tetraphyllum, Adiantum trapeziforme, Adiantum venustum, Adiantum viridescens*, and *Adiantum viridimontanum*.

In some embodiments the nucleic acid molecule encoding the PtIP-83 polypeptide is derived from a fern species in the Order Polypodiales, Family Aspleniaceae, Genus *Asplenium*.

In some embodiments the nucleic acid molecule encoding the PtIP-83 polypeptide is derived from a fern species in the Order Polypodiales, Family Aspleniaceae, Genus *Aspleniuml* selected from but not limited to *Asplenium adiantum, Asplenium adulterinum, Asplenium aequibasis, Asplenium aethiopicum, Asplenium africanum, Asplenium×alternifolium, Asplenium angustum, Asplenium antiquum, Asplenium ascensionis, Asplenium attenuatum, Asplenium aureum, Asplenium auritum, Asplenium australasicum, Asplenium azoricum, Asplenium bifrons, Asplenium billottii, Asplenium bipinnatifidum, Asplenium brachycarpum, Asplenium bradleyi, Asplenium bulbiferum, Asplenium caudatum, Asplenium ceterach, Asplenium compressum, Asplenium conges-* tum, *Asplenium corderoanum*, *Asplenium crinicaule*, *Asplenium cristatum*, *Asplenium cuneifolium*, *Asplenium cymbifolium*, *Asplenium daghestanicum*, *Asplenium dalhousiae*, *Asplenium dareoides*, *Asplenium daucifolium*, *Asplenium difforme*, *Asplenium fissum*, *Asplenium dimorphum*, *Asplenium divaricatum*, *Asplenium dregeanum*, *Asplenium×ebenoides*, *Asplenium ecuadorense*, *Asplenium feei Kunze*, *Asplenium fissum*, *Asplenium flabellifolium*, *Asplenium flaccidum*, *Asplenium fontanum*, *Asplenium forisiense*, *Asplenium formosum*, *Asplenium gemmiferum*, *Asplenium×germanicum*, *Asplenium gueinzii*, *Asplenium goudeyi*, *Asplenium hemionitis*, *Asplenium hermannii-christii*, *Asplenium hookerianum*, *Asplenium hybridum*, *Asplenium incisum*, *Asplenium×jacksonii*, *Asplenium×kenzoi*, *Asplenium laciniatum*, *Asplenium lamprophyllum*, *Asplenium laserpitiifolium*, *Asplenium lepidum*, *Asplenium listeri*, *Asplenium longissimum*, *Asplenium lucidum*, *Asplenium lunulatum*, *Asplenium lyallii*, *Asplenium macedonicum*, *Asplenium majoricum*, *Asplenium marinum*, *Asplenium×microdon*, *Asplenium milnei*, *Asplenium montanum*, *Asplenium musifolium*, *Asplenium nidus*, *Asplenium normale*, *Asplenium obliquum*, *Asplenium oblongifolium*, *Asplenium obovatum*, *Asplenium obtusatum*, *Asplenium oligolepidum*, *Asplenium oligophlebium*, *Asplenium onopteris*, *Asplenium pacificum*, *Asplenium paleaceum*, *Asplenium palmeri*, *Asplenium petrarchae*, *Asplenium pinnatifidum*, *Asplenium planicaule*, *Asplenium platybasis*, *Asplenium platyneuron*, *Asplenium polyodon*, *Asplenium praemorsum*, *Asplenium prolongatum*, *Asplenium pteridoides*, *Asplenium resiliens*, *Asplenium rhizophyllum*, *Asplenium richardii*, *Asplenium ruprechtii*, *Asplenium ruta-muraria*, *Asplenium rustifolium*, *Asplenium sagittatum*, *Asplenium sandersonii*, *Asplenium×sarniense*, *Asplenium schizotrichum*, *Asplenium schweinfurthii*, *Asplenium scleroprium*, *Asplenium scolopendrium* (syn. *Phyllitis scolopendrium*), *Asplenium seelosii*, *Asplenium septentrionale*, *Asplenium septentrionale×trichomanes*, *Asplenium serra*, *Asplenium serratum*, *Asplenium sessilifolium*, *Asplenium shuttleworthianum*, *Asplenium simplicifrons*, *Asplenium splendens*, *Asplenium surrogatum*, *Asplenium tenerum*, *Asplenium terrestre*, *Asplenium theciferum*, *Asplenium thunbergii*, *Asplenium trichomanes*, *Asplenium tutwilerae*, *Asplenium vespertinum*, *Asplenium vieillardii*, *Asplenium virens*, *Asplenium viride*, *Asplenium vittiforme*, and *Asplenium viviparum*.

In some embodiments the nucleic acid molecule encoding the PtIP-83 polypeptide is derived from a fern species in the Order Polypodiales, Family Blechnaceae, Genus *Blecnum*.

In some embodiments the nucleic acid molecule encoding the PtIP-83 polypeptide is derived from a fern species in the Order Polypodiales, Family Dryopteridaceae Genus *Acrophorus*, Genus *Acrorumohra*, Genus *Anapausia*, Genus *Arachniodes*, Genus *Bolbitis*, Genus *Ctenitis*, Genus *Cyclodium*, Genus *Cyrtogonellum*, Genus *Cyrtomidictyum*, Genus *Cyrtomium*, Genus *Diacalpe*, Genus *Didymochlaena*, Genus *Dryopsis*, Genus *Dryopteris*, Genus *Elaphoglossum*, Genus *Hypodematium*, Genus *Lastreopsis*, Genus *Leptorumohra*, Genus *Leucostegia*, Genus *Lithostegia*, Genus *Lomagramma*, Genus *Maxonia*, Genus *Megalastrum*, Genus *Olfersia*, Genus *Peranema*, Genus *Phanerophlebia*, Genus *Phanerophlebiopsis*, Genus *Polybotrya*, Genus *Polystichopsis*, Genus *Polystichum*, Genus *Rumohra*, Genus *Sorolepidium*, Genus *Stigmatopteris* or Genus *Teratophyllum*.

In some embodiments the nucleic acid molecule encoding the PtIP-83 polypeptide is derived from a fern species in the Order Polypodiales, Family Dryopteridaceae, Genus *Polystichum*. In some embodiments the nucleic acid molecule encoding the PtIP-83 polypeptide is derived from a fern species in the Order Polypodiales, Family Dryopteridaceae, Genus *Polystichum* selected from but not limited to *Polystichum acanthophyllum*, *Polystichum acrostichoides*, *Polystichum aculeatum*, *Polystichum acutidens*, *Polystichum acutipinnulum*, *Polystichum alcicorne*, *Polystichum aleuticum*, *Polystichum andersonii*, *Polystichum atkinsonii*, *Polystichum australiense*, *Polystichum bakerianum*, *Polystichum biaristatum*, *Polystichum bomiense*, *Polystichum bonseyi*, *Polystichum brachypterum*, *Polystichum braunii*, *Polystichum brachypterum*, *Polystichum calderonense*, *Polystichum californicum*, *Polystichum capillipes*, *Polystichum castaneum*, *Polystichum chilense*, *Polystichum christii Ching*, *Polystichum chunii Ching*, *Polystichum craspedosorum*, *Polystichum cyclolobum*, *Polystichum cystostegia*, *Polystichum deltodon*, *Polystichum dielsii*, *Polystichum discretum*, *Polystichum drepanum*, *Polystichum dudleyi*, *Polystichum duthiei*, *Polystichum echinatum*, *Polystichum erosum*, *Polystichum excellens*, *Polystichum eximium*, *Polystichum falcatipinnum*, *Polystichum falcinellum*, *Polystichum fallax*, *Polystichum formosanum*, *Polystichum gongboense*, *Polystichum grandifrons*, *Polystichum gymnocarpium*, *Polystichum haleakalense*, *Polystichum hancockii*, *Polystichum hecatopteron*, *Polystichum herbaceum*, *Polystichum imbricans*, *Polystichum incongruum*, *Polystichum kruckebergii*, *Polystichum kwakiutlii*, *Polystichum lachenense*, *Polystichum lanceolatum*, *Polystichum lemmonii*, *Polystichum lentum*, *Polystichum lonchitis*, *Polystichum longidens*, *Polystichum longipaleatum*, *Polystichum longipes*, *Polystichum luctuosum*, *Polystichum macleae*, *Polystichum macrochlaenum*, *Polystichum makinoi*, *Polystichum martini*, *Polystichum mayebarae*, *Polystichum mediocre*, *Polystichum medogense*, *Polystichum microchlamys*, *Polystichum mohrioides*, *Polystichum mollissimum*, *Polystichum monticola*, *Polystichum moorei*, *Polystichum morii*, *Polystichum moupinense*, *Polystichum muricatum*, *Polystichum nakenense*, *Polystichum neolobatum*, *Polystichum nepalense*, *Polystichum ningshenense*, *Polystichum obliquum*, *Polystichum omeiense*, *Polystichum ordinatum*, *Polystichum orientalitibeticum*, *Polystichum paramoupinense*, *Polystichum parvipinnulum*, *Polystichum piceopalea-ceum*, *Polystichum polyblepharum*, *Polystichum prescottianum*, *Polystichum prionolepis*, *Polystichum proliferum*, *Polystichum pseudocastaneum*, *Polystichum pseudomakinoi*, *Polystichum punctiferum*, *Polystichum pungens*, *Polystichum qamdoense*, *Polystichum retrosopaleaceum*, *Polystichum rhombiforme*, *Polystichum rhomboidea*, *Polystichum richardii*, *Polystichum rigens*, *Polystichum rotundilobum*, *Polystichum scopulinum*, *Polystichum semifertile*, *Polystichum setiferum*, *Polystichum setigerum*, *Polystichum shensiense*, *Polystichum silvaticum*, *Polystichum simplicipinnum*, *Polystichum sinense*, *Polystichum squarrosum*, *Polystichum stenophyllum*, *Polystichum stimulans*, *Polystichum submite*, *Polystichum tacticopterum*, *Polystichum thomsoni*, *Polystichum tibeticum*, *Polystichum transvaalense*, *Polystichum tripteron*, *Polystichum tsus-simense*, *Polystichum vestitum*, *Polystichum wattii*, *Polystichum whiteleggei*, *Polystichum xiphophyllum*, *Polystichum yadongense*, and *Polystichum yunnanense*.

In some embodiments the nucleic acid molecule encoding the PtIP-83 polypeptide is derived from a fern species in the Order Polypodiales, Family Dryopteridaceae, Genus *Rumohra*. In some embodiments the nucleic acid molecule encoding the PtIP-83 polypeptide is derived from a fern species in the Order Polypodiales, Family Dryopteridaceae, Genus *Rumohra* selected from but not limited to *Rumohra adiantiformis*, *Rumohra aristata*, *Rumohra bartonae*, *Rumohra berteroana*, *Rumohra capuronii*, *Rumohra glan-

*dulosa, Rumohra humbertii, Rumohra linearisquamosa, Rumohra lokohensis, Rumohra madagascarica,* and *Rumohra quadrangularis.*

In some embodiments the nucleic acid molecule encoding the PtIP-83 polypeptide is derived from a fern species in the Order Polypodiales, Family Polypodiaceae Genus *Campyloneurum*, Genus *Drynaria*, Genus *Lepisorus*, Genus *Microgramma*, Genus *Microsorum*, Genus *Neurodium*, Genus *Niphidium*, Genus *Pecluma* M.G., Genus *Phlebodium*, Genus *Phymatosorus*, Genus *Platycerium*, Genus *Pleopeltis*, Genus *Polypodium*.

In some embodiments the PtIP-83 polypeptide is derived from a fern species in the Order Polypodiales, Family Polypodiaceae, Genus *Microsorum*.

In some embodiments the nucleic acid molecule encoding the PtIP-83 polypeptide is derived from a fern species in the Order Polypodiales, Family Polypodiaceae, Genus *Microsorum*. selected from but not limited to *Microsorum alatum, Microsorum angustifolium, Microsorum aurantiacum, Microsorum australiense, Microsorum baithoense, Microsorum basicordatum, Microsorum biseriatum, Microsorum brassii, Microsorum buergerianum, Microsorum chapaense, Microsorum cinctum, Microsorum commutatum, Microsorum congregatifolium, Microsorum cuneatum, Microsorum cuspidatum, Microsorum dengii, Microsorum egregium, Microsorum emeiensis, Microsorum ensatum, Microsorum ensiforme, Microsorum excelsum, Microsorum fortunei, Microsorum griseorhizoma, Microsorum grossum, Microsorum hemionitideum, Microsorum henryi, Microsorum heterocarpum, Microsorum heterolobum, Microsorum howense, Microsorum insigne, Microsorum intermedium, Microsorum kongtingense, Microsorum krayanense, Microsorum lanceolatum, Microsorum lancifolium, Microsorum lastii, Microsorum latilobatum, Microsorum leandrianum, Microsorum lineare, Microsorum linguiforme, Microsorum longissimum, Microsorum longshengense, Microsorum maculosum, Microsorum maximum, Microsorum membranaceum, Microsorum membranifolium, Microsorum microsorioides, Microsorum minor, Microsorum monstrosum, Microsorum muliense, Microsorum mutense, Microsorum nanchuanense, Microsorum ningpoense, Microsorum normale, Microsorum novae-zealandiae, Microsorum ovalifolium, Microsorum ovatum, Microsorum palmatopedatum, Microsorum pappei, Microsorum papuanum, Microsorum parksii, Microsorum pentaphyllum, Microsorum piliferum, Microsorum pitcairnense, Microsorum powellii, Microsorum pteropodum, Microsorum pteropus, Microsorum punctatum, Microsorum pustulatum, Microsorum rampans, Microsorum revolutum, Microsorum rubidum, Microsorum samarense, Microsorum sapaense, Microsorum sarawakense, Microsorum scandens, Microsorum scolopendria, Microsorum sibomense, Microsorum sinense, Microsorum sopuense, Microsorum spectrum, Microsorum steerei, Microsorum subhemionitideum, Microsorum submarginale, Microsorum subnudum, Microsorum superficiale, Microsorum takhtajanii, Microsorum tenuipes, Microsorum tibeticum, Microsorum triglossum, Microsorum truncatum, Microsorum tsaii, Microsorum varians, Microsorum venosum, Microsorum vieillardii, Microsorum×inaequibasis, Microsorum yiliangensis,* and *Microsorum zippelii.*

In some embodiments the nucleic acid molecule encoding the PtIP-83 polypeptide is derived from a fern species in the Order Polypodiales, Family Polypodiaceae, Genus *Polypodium* L. In some embodiments the nucleic acid molecule encoding the PtIP-83 polypeptide is derived from a fern species in the Order Polypodiales, Family Polypodiaceae, Genus *Polypodium* L. selected from but not limited to *Polypodium absidatum, Polypodium acutifolium, Polypodium adiantiforme, Polypodium aequale, Polypodium affine, Polypodium albidopaleatum, Polypodium alcicorne, Polypodium alfarii, Polypodium alfredii, Polypodium alfredii* var. *curtii, Polypodium allosuroides, Polypodium alsophilicola, Polypodium amamianum, Polypodium amoenum, Polypodium amorphum, Polypodium anetioides, Polypodium anfractuosum, Polypodium anguinum, Polypodium angustifolium* f. *remotifolia, Polypodium angustifolium* var. *amphostenon, Polypodium angustifolium* var. *heterolepis, Polypodium angustifolium* var. *monstrosa, Polypodium angustipaleatum, Polypodium angustissimum, Polypodium anisomeron* var. *pectinatum, Polypodium antioquianum, Polypodium aoristisorum, Polypodium apagolepis, Polypodium apicidens, Polypodium apiculatum, Polypodium apoense, Polypodium appalachianum, Polypodium appressum, Polypodium arenarium, Polypodium argentinum, Polypodium argutum, Polypodium armatum, Polypodium aromaticum, Polypodium aspersum, Polypodium assurgens, Polypodium atrum, Polypodium auriculatum, Polypodium balaonense, Polypodium balliviani, Polypodium bamleri, Polypodium bangii, Polypodium bartlettii, Polypodium basale, Polypodium bernoullii, Polypodium biauritum, Polypodium bifrons, Polypodium blepharodes, Polypodium bolivari, Polypodium bolivianum, Polypodium bolobense, Polypodium bombycinum, Polypodium bombycinum* var. *insularum, Polypodium bradeorum, Polypodium bryophilum, Polypodium bryopodum, Polypodium buchtienii, Polypodium buesii, Polypodium bulbotrichum, Polypodium caceresii, Polypodium californicum* f. *brauscombii, Polypodium californicum* f. *parsonsiae, Polypodium californicum, Polypodium calophlebium, Polypodium calvum, Polypodium camptophyllarium* var. *abbreviatum, Polypodium capitellatum, Polypodium carpinterae, Polypodium chachapoyense, Polypodium chartaceum, Polypodium chimantense, Polypodium chiricanum, Polypodium choquetangense, Polypodium christensenii, Polypodium christii, Polypodium chrysotrichum, Polypodium ciliolepis, Polypodium cinerascens, Polypodium collinsii, Polypodium colysoides, Polypodium confluens, Polypodium conforme, Polypodium confusum, Polypodium congregatifolium, Polypodium connellii, Polypodium consimile* var. *bourgaeanum, Polypodium consimile* var. *minor, Polypodium conterminans, Polypodium contiguum, Polypodium cookii, Polypodium coriaceum, Polypodium coronans, Polypodium costaricense, Polypodium costatum, Polypodium crassifolium* f. *angustissimum, Polypodium crassifolium* var. *longipes, Polypodium crassulum, Polypodium craterisorum, Polypodium cryptum, Polypodium crystalloneuron, Polypodium cucullatum* var. *planum, Polypodium cuencanum, Polypodium cumingianum, Polypodium cupreolepis, Polypodium curranii, Polypodium curvans, Polypodium cyathicola, Polypodium cyathisorum, Polypodium cyclocolpon, Polypodium daguense, Polypodium damunense, Polypodium dareiformioides, Polypodium dasypleura, Polypodium decipiens, Polypodium decorum, Polypodium delicatulum, Polypodium deltoideum, Polypodium demeraranum, Polypodium denticulatum, Polypodium diaphanum, Polypodium dilatatum, Polypodium dispersum, Polypodium dissectum, Polypodium dissimulans, Polypodium dolichosorum, Polypodium dolorense, Polypodium donnell-smithii, Polypodium drymoglossoides, Polypodium ebeninum, Polypodium eggersii, Polypodium elmeri, Polypodium elongatum, Polypodium enterosoroides, Polypodium erubescens, Polypodium erythrolepis, Polypodium erythrotrichum, Polypodium eurybasis, Polypodium eurybasis* var. *villosum, Polypodium*

*exornans, Polypodium falcoideum, Polypodium fallacissimum, Polypodium farinosum, Polypodium faucium, Polypodium feei, Polypodium ferrugineum, Polypodium feuillei, Polypodium firmulum, Polypodium firmum, Polypodium flaccidum, Polypodium flagellare, Polypodium flexuosum, Polypodium flexuosum* var. *ekmanii, Polypodium forbesii, Polypodium formosanum, Polypodium fraxinifolium* subsp. *articulatum, Polypodium fraxinifolium* subsp. *luridum, Polypodium fructuosum, Polypodium fucoides, Polypodium fulvescens, Polypodium galeottii, Polypodium glaucum, Polypodium glycyrrhiza, Polypodium gracillimum, Polypodium gramineum, Polypodium grandifolium, Polypodium gratum, Polypodium graveolens, Polypodium griseo-nigrum, Polypodium griseum, Polypodium guttatum, Polypodium haalilioanum, Polypodium hammatisorum, Polypodium hancockii, Polypodium haplophlebicum, Polypodium harrisii, Polypodium hastatum* var. *simplex, Polypodium hawaiiense, Polypodium heanophyllum, Polypodium helleri, Polypodium hemionitidium, Polypodium henryi, Polypodium herzogii, Polypodium hesperium, Polypodium hessii, Polypodium hombersleyi, Polypodium hostmannii, Polypodium humile, Polypodium hyalinum, Polypodium iboense, Polypodium induens* var. *subdentatum, Polypodium insidiosum, Polypodium insigne, Polypodium intermedium* subsp. *masafueranum* var. *obtuseserratum, Polypodium intramarginale, Polypodium involutum, Polypodium itatiayense, Polypodium javanicum, Polypodium juglandifolium, Polypodium kaniense, Polypodium knowltoniorum, Polypodium kyimbilense, Polypodium l'herminieri* var. *costaricense, Polypodium lachniferum* f. *incurvata, Polypodium lachniferum* var. *glabrescens, Polypodium lachnopus, Polypodium lanceolatum* var. *complanatum, Polypodium lanceolatum* var. *trichophorum, Polypodium latevagans, Polypodium laxifrons, Polypodium laxifrons* var. *lividum, Polypodium lehmannianum, Polypodium leiorhizum, Polypodium leptopodon, Polypodium leuconeuron* var. *angustifolia, Polypodium leuconeuron* var. *latifolium, Polypodium leucosticta, Polypodium limulum, Polypodium lindigii, Polypodium lineatum, Polypodium lomarioides, Polypodium longifrons, Polypodium loretense, Polypodium loriceum* var. *umbraticum, Polypodium loriforme, Polypodium loxogramme* f. *gigas, Polypodium ludens, Polypodium luzonicum, Polypodium lycopodioides* f. *obtusum, Polypodium lycopodioides* L., *Polypodium macrolepis, Polypodium macrophyllum, Polypodium macrosorum, Polypodium macrosphaerum, Polypodium maculosum, Polypodium madrense, Polypodium manmeiense, Polypodium margaritiferum, Polypodium maritimum, Polypodium martensii, Polypodium mayoris, Polypodium megalolepis, Polypodium melanotrichum, Polypodium menisciifolium* var. *pubescens, Polypodium menisciodes, Polypodium merrillii, Polypodium mettenii, Polypodium mexiae, Polypodium microsorum, Polypodium militare, Polypodium minimum, Polypodium minusculum, Polypodium mixtum, Polypodium mollendense, Polypodium mollissimum, Polypodium moniliforme* var. *minus, Polypodium monoides, Polypodium monticola, Polypodium montigenum, Polypodium moritzianum, Polypodium moultonii, Polypodium multicaudatum, Polypodium multilineatum, Polypodium multisorum, Polypodium munchii, Polypodium muscoides, Polypodium myriolepis, Polypodium myriophyllum, Polypodium myriotrichum, Polypodium nematorhizon, Polypodium nemorale, Polypodium nesioticum, Polypodium nigrescentium, Polypodium nigripes, Polypodium nigrocinctum, Polypodium nimbatum, Polypodium nitidissimum, Polypodium nitidissimum* var. *latior, Polypodium nubrigenum, Polypodium oligolepis, Polypodium oligosorum, Polypodium oligosorum, Polypodium olivaceum, Polypodium olivaceum* var. *elatum, Polypodium oodes, Polypodium oosphaerum, Polypodium oreophilum, Polypodium ornatissimum, Polypodium ornatum, Polypodium ovatum, Polypodium oxylobum, Polypodium oxypholis, Polypodium pakkaense, Polypodium pallidum, Polypodium palmatopedatum, Polypodium palmeri, Polypodium panamense, Polypodium parvum, Polypodium patagonicum, Polypodium paucisorum, Polypodium pavonianum, Polypodium pectinatum* var. *caliense, Polypodium pectinatum* var. *hispidum, Polypodium pellucidum, Polypodium pendulum* var. *boliviense, Polypodium percrassum, Polypodium perpusillum, Polypodium peruvianum* var. *subgibbosum, Polypodium phyllitidis* var. *elongatum, Polypodium pichinchense, Polypodium pilosissimum, Polypodium pilosissimum* var. *glabriusculum, Polypodium pilossimum* var. *tunguraquensis, Polypodium pityrolepis, Polypodium platyphyllum, Polypodium playfairii, Polypodium plebeium* var. *cooperi, Polypodium plectolepidioides, Polypodium pleolepis, Polypodium plesiosorum* var. i, *Polypodium podobasis, Polypodium podocarpum, Polypodium poloense, Polypodium polydatylon, Polypodium polypodioides* var. *aciculare, Polypodium polypodioides* var. *michauxianum, Polypodium praetermissum, Polypodium preslianum* var. *immersum, Polypodium procerum, Polypodium procerum, Polypodium productum, Polypodium productum, Polypodium prolongilobum, Polypodium propinguum, Polypodium proteus, Polypodium pruinatum, Polypodium pseudocapillare, Polypodium pseudofraternum, Polypodium pseudonutans, Polypodium pseudoserratum, Polypodium pulcherrimum, Polypodium pulogense, Polypodium pungens, Polypodium purpusii, Polypodium radicale, Polypodium randallii, Polypodium 25 ratiborii, Polypodium reclinatum, Polypodium recreense, Polypodium repens* var. *abruptum, Polypodium revolvens, Polypodium rhachipterygium, Polypodium rhomboideum, Polypodium rigens, Polypodium robustum, Polypodium roraimense, Polypodium roraimense, Polypodium rosei, Polypodium rosenstockii, Polypodium rubidum, Polypodium rudimentum, Polypodium rusbyi, Polypodium sablanianum, Polypodium sarmentosum, Polypodium saxicola, Polypodium schenckii, Polypodium schlechteri, Polypodium scolopendria, Polypodium scolopendria, Polypodium scolopendrium, Polypodium scouleri, Polypodium scutulatum, Polypodium segregatum, Polypodium semihirsutum, Polypodium semihirsutum* var. *fuscosetosum, Polypodium senile* var. *minor, Polypodium sericeolanatum, Polypodium serraeforme, Polypodium serricula, Polypodium sesquipedala, Polypodium sessilifolium, Polypodium setosum* var. *calvum, Polypodium setulosum, Polypodium shaferi, Polypodium sibomense, Polypodium siccum, Polypodium simacense, Polypodium simulans, Polypodium singeri, Polypodium sinicum, Polypodium sintenisii, Polypodium skutchii, Polypodium sloanei, Polypodium sodiroi, Polypodium sordidulum, Polypodium sordidum, Polypodium sphaeropteroides, Polypodium sphenodes, Polypodium sprucei, Polypodium sprucei* var. *furcativenosa, Polypodium steirolepis, Polypodium stenobasis, Polypodium stenolepis, Polypodium stenopterum, Polypodium subcapillare, Polypodium subflabelliforme, Polypodium subhemionitidium, Polypodium subinaequale, Polypodium subintegrum, Polypodium subspathulatum, Polypodium subtile, Polypodium subvestitum, Polypodium subviride, Polypodium superficiale* var. *attenuatum, Polypodium superficiale* var. *chinensis, Polypodium sursumcurrens, Polypodium tablazianum, Polypodium taenifolium, Polypodium tamandarei, Polypodium tatei, Polypodium tenuiculum* var. *acrosora, Polypodium tenuiculum* var. *brasiliense, Polypodium tenuilore, Polypodium tenuinerve, Polypodium*

*tepuiense, Polypodium teresae, Polypodium tetragonum* var. *incompletum, Polypodium thysanolepis* var. *bipinnatifidum, Polypodium thyssanolepis,* var. *thyssanolepis, Polypodium thyssanolepsi, Polypodium tobagense, Polypodium trichophyllum, Polypodium tridactylum, Polypodium tridentatum, Polypodium trifurcatum* var. *brevipes, Polypodium triglossum, Polypodium truncatulum, Polypodium truncicola* var. *major, Polypodium truncicola* var. *minor, Polypodium tuberosum, Polypodium tunguraguae, Polypodium turquinum, Polypodium turrialbae, Polypodium ursipes, Polypodium vagans, Polypodium valdealatum, Polypodium versteegii, Polypodium villagranii, Polypodium virginianum* f. *cambroideum, Polypodium virginianum* f. *peraferens, Polypodium vittarioides, Polypodium vulgare, Polypodium vulgare* L., *Polypodium vulgare* subsp. *oreophilum, Polypodium vulgare* var. *acuminatum, Polypodium vulpinum, Polypodium williamsii, Polypodium wobbense, Polypodium×fallacissimum-guttatum, Polypodium xantholepis, Polypodium xiphopteris, Polypodium yarumalense, Polypodium yungense,* and *Polypodium zosteriforme.*

In some embodiments the nucleic acid molecule encoding the PtIP-83 polypeptide is derived from a fern species in the Order Polypodiales, Family Polypodiaceae, Genus *Platycerium*.

In some embodiments the nucleic acid molecule encoding the PtIP-83 polypeptide is derived from a species in the Division Lycophyta. The phylogeny of extant Lycopods as used herein is based on the classification by N. Wikstrom, *American Fern Journal,* 91:150-156 (2001). Other phylogenic classifications of extant Lycopods are known to one skilled in the art. Additional information on the phylogeny of ferns can be found at mobot.org/MOBOT/research/APweb/ (which can be accessed using the "www" prefix) and Schuettpelz E. and Pryer K. M., *TAXON* 56: 1037-1050 (2007) based on three plastid genes. Additional Lycopod species can be found at homepages.caverock.net.nz/~bj/fern/list.htm (which can be accessed using the http:// prefix).

In some embodiments the nucleic acid molecule encoding the PtIP-83 polypeptide is derived from a species in the Class Isoetopsida or Class Lycopodiopsida.

In some embodiments the nucleic acid molecule encoding the PtIP-83 polypeptide is derived from a species in the Class Isoetopsida, Order Selaginales. In some embodiments the nucleic acid molecule encoding the PtIP-83 polypeptide is derived from a fern species in the Class Isoetopsida, Order Selaginales, Family Selaginellaceae. In some embodiments the nucleic acid molecule encoding the PtIP-83 polypeptide is derived from a species in the Genus *Selaginella*.

In some embodiments the nucleic acid molecule encoding the PtIP-83 polypeptide is derived from a species in the Class Lycopodiopsida, Order Lycopodiales. In some embodiments the nucleic acid molecule encoding the PtIP-83 polypeptide is derived from a fern species in the Class Lycopodiopsida, Order Lycopodiales Family Lycopodiaceae or Family Huperziaceae. In some embodiments the nucleic acid molecule encoding the PtIP-83 polypeptide is derived from a species in the Genus *Austrolycopodium, Dendrolycopodium, Diphasiastrum, Diphasium, Huperzia, Lateristachys, Lycopodiastrum, Lycopodiella, Lycopodium, Palhinhaea, Pseudodiphasium, Pseudolycopodiella, Pseudolycopodium* or *Spinulum*. In some embodiments the nucleic acid molecule encoding the PtIP-83 polypeptide is derived from a species in the Genus *Lycopodium*.

In some embodiments the nucleic acid molecule encodes a PtIP-83 polypeptide comprises an amino acid sequence MOTIF selected from: an amino acid sequence MOTIF 1 as represented by an amino acid sequence of the formula MP[DE]MPSEADWSIFVNE[IV]EAVAEGMPTEVSEVP[AV]WKAKCKN[MV]AALGREM[SC]I (SEQ ID NO: 646); an amino acid sequence MOTIF 2 as represented by an amino acid sequence of the formula PQLQYRMYG[NS]LI[KN]QMAQVAQNYDQ[ED]FKQ[FL]KLFI[IA]QNQI[LF]GSYLLQQN[KR]A F (SEQ ID NO: 647); an amino acid sequence MOTIF 3 as represented by an amino acid sequence of the formula NTFMQMTPFTRWRLRLSASASENA[EG]LAFPTATA[PL]DSTT[EQ][IV]VITFHVTAIR (SEQ ID NO: 648); an amino acid sequence MOTIF 4 as represented by an amino acid sequence of the formula [DN]FTSRHVVK[GD]IPVSLLLDGEDWEFEIPVQ[AG]GMSSFP (SEQ ID NO: 649); an amino acid sequence MOTIF 5 as represented by an amino acid sequence of the formula IIHQP[SA]T[RQ][ST]G[IT]VYILLQGSTIFHDRRR[DE]EVMTFQAA[DA]PLN[FY][QH]YAYRLDT G (SEQ ID NO: 650); an amino acid sequence MOTIF 6 as represented by an amino acid sequence of the formula S[HQ]ADRLAAIQP[AV]DLTN[HY]LEMAT[HQ]MDMRTT[RS][MI]L[IL]GLLN[MI]LRIQNAALMY EY (SEQ ID NO: 651); an amino acid sequence MOTIF 7 as represented by an amino acid sequence of the formula [VL]DRVEFSEVMVIHRMYVRL[SA]DL[ND]VGEL[PE]GA[EG][RK]VKR[VL]YV[FL]ADWE (SEQ ID NO: 652); an amino acid sequence MOTIF 8 as represented by an amino acid sequence of the formula A[DE]RELQMESFHSAVISQRRQEL[ND]TA[IF]AKM[DE]R[LM]SLQMEEE[NS]RAMEQAQKE M (SEQ ID NO: 653); an amino acid sequence MOTIF 9 as represented by an amino acid sequence of the formula FVTAGATAPGA[AV]ASAGQAVSIAGQAAQ[AG]LRRWEILE[GQ]LEAVMEWAA[VI]K (SEQ ID NO: 654); an amino acid sequence MOTIF 10 as represented by an amino acid sequence of the formula DGMNWG[IT]YI[YH]GE[KE]V[EQ]RSPLLPSNAILAVWADRC[TI]ITSARHNH[VF]NAPGR[IV]I (SEQ ID NO: 655); an amino acid sequence MOTIF 11 as represented by an amino acid sequence of the formula [KV][VK][CA]RPPSPDM[MV]SAVAEHALWLNDVLLQWQ[KN]ESQ[LM]QGT[AE]PYNECLAL LGR (SEQ ID NO: 656); an amino acid sequence MOTIF 12 as represented by an amino acid sequence of the formula PTELT[VA]WPLGMDTV[AG]NLLIAQENAAL[VL]GLIQLGPSS (SEQ ID NO: 657); an amino acid sequence MOTIF 13 as represented by an amino acid sequence of the formula RDQ[MT][HQ]MPGSVTVI[IV]LCRLLQFP[IT]DGSQA[TA]T (SEQ ID NO: 658); an amino acid sequence MOTIF 14 as represented by an amino acid sequence of the formula TSIPVEVVTDP[SN]ILLGMQTTV[LH]IAEL (SEQ ID NO: 659); an amino acid sequence MOTIF 15 as represented by an amino acid sequence of the formula EGLR[EQ]FQNRQVARA[VL]FAVLKAVA[MQ]I[AG] (SEQ ID NO: 660); an amino acid sequence MOTIF 16 as represented by an amino acid sequence of the formula W[TS]RVRIRHLEM[QH]F[AV]QEASG (SEQ ID NO: 661); an amino acid sequence MOTIF 17 as represented by an amino acid sequence of the formula QISELQY[ED]IWVQG[LM][ML]RDIA (SEQ ID NO: 662); an amino acid sequence MOTIF 18 as represented by an amino acid sequence of the formula TFTLGSGVTGITSMHGEPSLDPWNGVSLDSASPTAF (SEQ ID NO: 663); an amino acid sequence MOTIF 19 as represented by an amino acid sequence of the formula MDYSTLYRDLNQIS (SEQ ID NO: 664); an amino acid sequence MOTIF 20 as represented by an amino acid sequence of the formula LRLPFM[QK]LHARVIEQN[VR]K[SE] (SEQ ID NO: 665); an amino acid sequence MOTIF 21 as represented by an amino acid sequence of the formula VDSLEQVG[QH][IL]V[GD]AP (SEQ ID NO: 666); an amino acid sequence MOTIF 22 as represented by an amino acid sequence of the formula [IV][EQ][CA]VMK[IM]GRF[VG][SL]W (SEQ ID NO: 667); an amino acid sequence MOTIF 23 as represented by an amino acid sequence of the formula TLTNEPSE[EQ]F (SEQ ID NO: 668); and an amino acid sequence MOTIF 24 as represented by an amino acid sequence of the formula LPRQSRNISF (SEQ ID NO: 669).

In some embodiments the nucleic acid molecule encodes a PtIP-83 polypeptide comprises an amino acid sequence MOTIF selected from: an amino acid sequence MOTIF 1 having at least 90% sequence identity to the amino acid sequence as represented by the formula MP[DE]MPSEADWSIFVNE[IV]EAVAEGMPTEVSEVP[AV]WKAKCKN[MV]AALGREM[SC]I (SEQ ID NO: 646); an amino acid sequence MOTIF 2 having at least 90% sequence identity to the amino acid sequence as represented by the formula PQLQYRMYG[NS]LI[KN]QMAQVAQNYDQ[ED]FKQ[FL]KLFI[IA]QNQI[LF]GSYLLQQN[KR]A F (SEQ ID NO: 647); an amino acid sequence MOTIF 3 having at least 90% sequence identity to the amino acid sequence as represented by the formula NTFMQMTPFTRWRLRLSASASENA[EG]LAFPTATA[PL]DSTT[EQ][IV]VITFHVTAIR (SEQ ID NO: 648); an amino acid sequence MOTIF 4 having at least 90% sequence identity to the amino acid sequence as represented by the formula [DN]FTSRHVVK[GD]IPVSLLLDGEDWEFEIPVQ[AG]GMSSFP (SEQ ID NO: 649); an amino acid sequence MOTIF 5 having at least 90% sequence identity to the amino acid sequence as represented by the formula IIHQP[SA]T[RQ][ST]G[IT]VY-ILLQGSTIFHDRRR[DE]EVMTFQAA[DA]PLN[FY][QH]YAYRLDT G (SEQ ID NO: 650); an amino acid sequence MOTIF 6 having at least 90% sequence identity to the amino acid sequence as represented by the formula S[HQ]ADRLAAIQP[AV]DLTN[HY]LEMAT[HQ]MDMRTT[RS][MI]L[IL]GLLN[MI]LRIQNAALMY EY (SEQ ID NO: 651); an amino acid sequence MOTIF 7 having at least 90% sequence identity to the amino acid sequence as represented by the formula [VL]DRVEFSEVMVIHRMYVRL[SA]DL[ND]VGEL[PE]GA[EG][RK]VKR[VL]YV[FL]ADWE (SEQ ID NO: 652); an amino acid sequence MOTIF 8 having at least 90% sequence identity to the amino acid sequence as represented by the formula A[DE]RELQMESFHSAVISQRRQEL[ND]TA[IF]AKM[DE]R[LM]SLQMEEE[NS]RAMEQAQKE M (SEQ ID NO: 653); an amino acid sequence MOTIF 9 having at least 90% sequence identity to the amino acid sequence as represented by the formula FVTAGATAPGA[AV]ASAGQAVSIAGQAAQ[AG]LRRWEILE[GQ]LEAVMEWAA[VI]K (SEQ ID NO: 654); an amino acid sequence MOTIF 10 having at least 90% sequence identity to the amino acid sequence as represented by the formula DGMNWG[IT]YI[YH]GE[KE]V[EQ]RSPLLPSNAILAVWADRC[TI]ITSARHNH[VF]NAPGR[IV]I (SEQ ID NO: 655); an amino acid sequence MOTIF 11 having at least 90% sequence identity to the amino acid sequence as represented by the formula [KV][VK][CA]RPPSPDM[MV]SAVAEHALWLNDVLLQWQ[KN]ESQ[LM]QGT[AE]PYNECLAL LGR (SEQ ID NO: 656); an amino acid sequence MOTIF 12 having at least 90% sequence identity to the amino acid sequence as represented by the formula PTELT[VA]WPLGMDTV[AG]NLLIAQENAAL[VL]GLIQLGPSS (SEQ ID NO: 657); an amino acid sequence MOTIF 13 having at least 90% sequence identity to the amino acid sequence as represented by the formula RDQ[MT][HQ]MPGSVTVI[IV]LCRLLQFP[IT]DGSQA[TA]T (SEQ ID NO: 658); an amino acid sequence MOTIF 14 having at least 90% sequence identity to the amino acid sequence as represented by the formula TSIPVEWTDP[SN]ILLGMQTTV[LH]IAEL (SEQ ID NO: 659); an amino acid sequence MOTIF 15 having at least 90% sequence identity to the amino acid sequence as represented by the formula EGLR[EQ]FQNRQVARA[VL]FAVLKAVA[MQ]I[AG] (SEQ ID NO: 660); an amino acid sequence MOTIF 16 having at least 90% sequence identity to the amino acid sequence as represented by the formula W[TS]RVRIRHLEM[QH]F[AV]QEASG (SEQ ID NO: 661); an amino acid sequence MOTIF 17 having at least 90% sequence identity to the amino acid sequence as represented by the formula QISELQY[ED]IWVQG[LM][ML]RDIA (SEQ ID NO: 662); an amino acid sequence MOTIF 18 having at least 90% sequence identity to the amino acid sequence as represented by the formula TFTLGSGVTGITSMHGEPSLDPWNGVSLDSASPTAF (SEQ ID NO: 663); an amino acid sequence MOTIF 19 having at least 90% sequence identity to the amino acid sequence as represented by the formula MDYSTLYRDLNQIS (SEQ ID NO: 664); an amino acid sequence MOTIF 20 having at least 90% sequence identity to the amino acid sequence as represented by the formula LRLPFM[QK]LHARVIEQN[VR]K[SE] (SEQ ID NO: 665); an amino acid sequence MOTIF 21 having at least 90% sequence identity to the amino acid sequence as represented by the formula VDSLEQVG[QH][IL]V[GD]AP (SEQ ID NO: 666); an amino acid sequence MOTIF 22 having at least 90% sequence identity to the amino acid sequence as represented by the formula [IV][EQ][CA]VMK[IM]GRF[VG][SL]VV (SEQ ID NO: 667); an amino acid sequence MOTIF 23 having at least 90% sequence identity to the amino acid sequence as represented by the formula TLTNEPSE[EQ]F (SEQ ID NO: 668); and an amino acid sequence MOTIF 24 having at least 90% sequence identity to the amino acid sequence as represented by the formula LPRQSRNISF (SEQ ID NO: 669).

In some embodiments the nucleic acid molecule encodes a PtIP-83 polypeptide comprises an amino acid sequence MOTIF selected from: an amino acid sequence MOTIF 1 as represented by an amino acid sequence of the formula MP[DE]MP[ST][ED]ADWSIFVNE[IVL]EAVAEGMPTEVSEVP[AV]W[KR]AKCKN[MV]AALGRE M[SC]l (SEQ ID NO: 670); an amino acid sequence MOTIF 2 as represented by an amino acid sequence of the formula PQLQYRMYG[NS]LI[KRN]QMAQVAQNYD[QR][ED]FK[QR][FL][KR]LFI[IAVL]QNQI[LF]GSYL L[QE]QN[KR]AF (SEQ ID NO: 671); an amino acid sequence MOTIF 3 as represented by an amino acid sequence of the formula N[TK]FMQMTPFT[RH]WRLRLSASA[SPKA]E-N[AK][EG]LAFPTATA[PL]DSTT[EQ][IV][VA]ITF HVTAIR (SEQ ID NO: 672); an amino acid sequence MOTIF 4 as represented by an amino acid sequence of the formula [DN]FTSRHVVK[GD]IPV[SN]LLLDG[EG]DWEFEIPVQ[AG]GMSSFP (SEQ ID NO: 673); an amino acid sequence MOTIF 5 as represented by an amino acid sequence of the formula IIHQP[SA]T[RQ][ST]G[IT][VI]YILLQGST[IV]FHDRRR[DE][EQ]V[ML]T[FP]QAA[DAV]PLN[FY][QH]YAYRLDTG (SEQ ID NO: 674); an amino acid sequence MOTIF 6 as represented by an amino acid sequence of the formula S[HQ]ADRLAAIQP[AV][DN]LTN[HYF]LEMAT[HQ]MDMRTT[RS][MI]L[IL]GLLN[MI][LM]RIQN AAL[MR]YEY (SEQ ID NO: 675); an amino acid sequence MOTIF 7 as represented by an amino acid sequence of the formula [VL]D[RQ]VEFSEVMVIHRMYV[N]RL[SA]DL[ND]V[GA][EQ]L[PE]GA[EG][RK]VKR[VL]YV[FL]ADVVE (SEQ ID NO:

676); an amino acid sequence MOTIF 8 as represented by an amino acid sequence of the formula A[DE]RELQMESFH[SA]AVISQ[RK]R[QGE]EL[ND][TD][AT][IF]AKM[DE]R[LM]SLQMEEE[NS D][RG]AMEQA[QR]KEM (SEQ ID NO: 677); an amino acid sequence MOTIF 9 as represented by an amino acid sequence of the formula F[VL]TAGATAPGA[AV]ASAGQAV[SN]IAGQAAQ[AG]LRRVVEILE[GQ]LEAVMEVVAA[VI]K (SEQ ID NO: 678); an amino acid sequence MOTIF 10 as represented by an amino acid sequence of the formula D[GD][MA][NK]WG[IT]Y[IV][YH][GA]E[KE]V[EQ][RVL]SPL[LYF][PN][SNG][NW][ASP][IY]L[AG V]V[WE]A[DQ]R[CS][TI]IT[SA]A[RFM]HN[HVT][VF][ND][AER]PG[RW][IV][IR] (SEQ ID NO: 679); an amino acid sequence MOTIF 11 as represented by an amino acid sequence of the formula [KV][VK][CA][RGC][PHY]PSP[DE][MIL][MV]SAV[AG][EV]HA[LI N]WL[NS][DK]VLL[QR]WQ[K N]ES[QH][LM]QGT[AE][PSA]YNECLALLGR (SEQ ID NO: 680); an amino acid sequence MOTIF 12 as represented by an amino acid sequence of the formula [PN]T[EQ]LT[VAT]WPL[GR]M-DTV[AG][ND]LLI[AT][QH]E[NS]AAL[VLS]GL[ITMA]QLG[PQ][S P]S (SEQ ID NO: 681); an amino acid sequence MOTIF 13 as represented by an amino acid sequence of the formula [RLC][DLWK][QNPR][MTP][HQR][MIL]PGSVTVI[IV]LCRLLQFP[IT][DG]G[SR][QFR][AS][TAD][TW] (SEQ ID NO: 682); an amino acid sequence MOTIF 14 as represented by an amino acid sequence of the formula [TA][SGV][IL]PV[ED]WTDP[SN]IL[LM]GMQT[TS]V[LH]IAEL (SEQ ID NO: 683); an amino acid sequence MOTIF 15 as represented by an amino acid sequence of the formula EGLR[EQ]FQN[RE]QVA[RN]A[VL]FAVL[KS][AS]VA[MQ]I[AG] (SEQ ID NO: 684); an amino acid sequence MOTIF 16 as represented by an amino acid sequence of the formula W[TS]RVRIRHLEM[QH]F[AV][QK]E[AS][SM][GN] (SEQ ID NO: 685); an amino acid sequence MOTIF 17 as represented by an amino acid sequence of the formula Q[IM]S[EQ]LQY[ED]IWVQG[LM][ML]RD[IM]A (SEQ ID NO: 686); an amino acid sequence MOTIF 18 as represented by an amino acid sequence of the formula TFTLGSGVTGITSMHGEPSLD-PWNGVSLDSASPTAF (SEQ ID NO: 663); an amino acid sequence MOTIF 19 as represented by an amino acid sequence of the formula [MLV]DY[SK][TSK]L[YF][RE]DLNQIS (SEQ ID NO: 687); an amino acid sequence MOTIF 20 as represented by an amino acid sequence of the formula L[RHQ]L[PT]FM[QK]LHA[RIT][VQL][IR]E[QER][NF][VR][KWS][SE] (SEQ ID NO: 688); an amino acid sequence MOTIF 21 as represented by an amino acid sequence of the formula V[DN][SA]L[ED]QV[GS][QH][IL]V[GD]AP (SEQ ID NO: 689); an amino acid sequence MOTIF 22 as represented by an amino acid sequence of the formula [IV][EQH][CAS][VA][MI]K[IM][GV][RP][FI][VG][SL]W (SEQ ID NO: 690); an amino acid sequence MOTIF 23 as represented by an amino acid sequence of the formula TLTN[EQ]PSE[EQDH]F (SEQ ID NO: 691); and an amino acid sequence MOTIF 24 as represented by an amino acid sequence of the formula LP[RS]QS[RT]N[IV]SF (SEQ ID NO: 692).

In some embodiments the nucleic acid molecule encodes a PtIP-83 polypeptide comprises an amino acid sequence MOTIF selected from: an amino acid sequence MOTIF 1 having at least 90% sequence identity to the amino acid sequence as represented by the formula MP[DE]MP[ST][ED]ADWSIFVNE[IVL]EAVAEGMPTEVSEVP[AV]W[KR]AKCKN[MV]AALGRE M[SC]I (SEQ ID NO: 670); an amino acid sequence MOTIF 2 having at least 90% sequence identity to the amino acid sequence as represented by the formula PQLQYRMYG[NS]LI[KRN]QMAQVAQNYD[QR][ED]FK[QR][FL][KR]LFI[IAVL]QNQI[LF]GSYL L[QE]QN[KR]AF (SEQ ID NO: 671); an amino acid sequence MOTIF 3 having at least 90% sequence identity to the amino acid sequence as represented by the formula N[TK]FMQMTPFT[RH]WRLRLSASA[SP-KA]EN[AK][EG]LAFPTATA[PL]DSTT[EQ][IV][VA]ITF HVTAIR (SEQ ID NO: 672); an amino acid sequence MOTIF 4 having at least 90% sequence identity to the amino acid sequence as represented by the formula [DN]FTSRHV-VK[GD]IPV[SN]LLLDG[EG]DWEFEIPVQ[AG] GMSSFP (SEQ ID NO: 673); an amino acid sequence MOTIF 5 having at least 90% sequence identity to the amino acid sequence as represented by the formula IIHQP[SA]T[RQ][ST]G[IT][VI]YILLQGST[IV]FHDRRR[DE][EQ]V[ML]T[FP]QAA[DAV]PLN[FY][QH]YAYRLDTG (SEQ ID NO: 674); an amino acid sequence MOTIF 6 having at least 90% sequence identity to the amino acid sequence as represented by the formula S[HQ]ADRLAAIQP[AV][DN]LTN[HYF]LEMAT[HQ]MDMRTT[RS][MI]L[IL]GLLN[MI][LM]RIQN AAL[MR]YEY (SEQ ID NO: 675); an amino acid sequence MOTIF 7 having at least 90% sequence identity to the amino acid sequence as represented by the formula [VL]D[RQ]VEFSEVMVIHRMYV[N]RL[SA]DL[ND]V[GA][EQ]L[PE]GA[EG][RK]VKR[VL]YV[FL]ADVVE (SEQ ID NO: 676); an amino acid sequence MOTIF 8 having at least 90% sequence identity to the amino acid sequence as represented by the formula A[DE]R-ELQMESFH[SA]AVISQ[RK]R[QGE]EL[ND][TD][AT][IF]AKM[DE]R[LM]SLQMEEE[NS D][RG]AMEQA[QR]KEM (SEQ ID NO: 677); an amino acid sequence MOTIF 9 having at least 90% sequence identity to the amino acid sequence as represented by the formula F[VL]TAGATAP-GA[AV]ASAGQAV[SN]IAGQAAQ[AG]LRRVVEILE[GQ]LEAVMEVVAA[VI]K (SEQ ID NO: 678); an amino acid sequence MOTIF 10 having at least 90% sequence identity to the amino acid sequence as represented by the formula D[GD][MA][NK]WG[IT]Y[IV][YH][GA]E[KE]V[EQ][RVL]SPL[LYF][PN][SNG][NW][ASP][IY]L[AG V]V[WE]A[DQ]R[CS][TI]IT[SA]A[RFM]HN[HVT][VF][ND][AER]PG[RW][IV][IR] (SEQ ID NO: 679); an amino acid sequence MOTIF 11 having at least 90% sequence identity to the amino acid sequence as represented by the formula [KV][VK][CA][RGC][PHY]PSP[DE][MIL][MV]SAV[AG][EV]HA[LI N]WL[NS][DK]VLL[QR]WQ[K N]ES[QH][LM]QGT[AE][PSA]YNECLALLGR (SEQ ID NO: 680); an amino acid sequence MOTIF 12 having at least 90% sequence identity to the amino acid sequence as represented by the formula [PN]T[EQ]LT[VAT]WPL[GR]MDTV[AG][ND]LLI[AT][QH]E[NS]AAL[VLS]GL[ITMA]QLG[PQ][S P]S (SEQ ID NO: 681); an amino acid sequence MOTIF 13 having at least 90% sequence identity to the amino acid sequence as represented by the formula [RLC][DLWK][QNPR][MTP][HQR][MIL]PGSVTVI[IV]LCRLLQFP[IT][DG]G[SR][QFR][AS][TAD][TW] (SEQ ID NO: 682); an amino acid sequence MOTIF 14 having at least 90% sequence identity to the amino acid sequence as represented by the formula [TA][SGV][IL]PV[ED]VVTDP[SN]IL[LM]GMQT[TS]V[LH]IAEL (SEQ ID NO: 683); an amino acid sequence MOTIF 15 having at least 90% sequence identity to the amino acid sequence as represented by the formula EGLR[EQ]FQN[RE]QVA[RN]A[VL]FAVL[KS][AS]VA[MQ]I[AG](SEQ ID NO: 684); an amino acid sequence MOTIF 16 having at least 90% sequence identity to the amino acid sequence as represented by the formula W[TS]RVRIRHLEM[QH]F[AV][QK]E[AS][SM][GN] (SEQ ID NO: 685); an amino acid sequence MOTIF 17 having at least 90% sequence identity to the amino acid sequence as represented by the formula Q[IM]S[EQ]LQY[ED]IWVQG[LM][ML]RD[IM]A (SEQ ID NO: 686); an amino acid sequence MOTIF 18 having at least 90% sequence identity to the amino acid sequence as represented by the formula TFTLGSGVTGITSMHGEPSLDP-WNGVSLDSASPTAF (SEQ ID NO: 663); an amino acid sequence MOTIF 19 having at least 90% sequence identity to the amino acid sequence as represented by the formula [MLV]DY[SK][TSK]L[YF][RE]DLNQIS (SEQ ID NO: 687); an amino acid sequence MOTIF 20 having at least 90% sequence identity to the amino acid sequence as represented by the formula L[RHQ]L[PT]FM[QK]LHA[R-IT][VQL][IR]E[QER][NF][VR][KWS][SE] (SEQ ID NO: 688); an amino acid sequence MOTIF 21 having at least 90% sequence identity to the amino acid sequence as represented by the formula V[DN][SA]L[ED]QV[GS][QH][IL]V[GD]AP (SEQ ID NO: 689); an amino acid sequence MOTIF 22 having at least 90% sequence identity to the amino acid sequence as represented by the formula [IV][EQH][CAS][VA][MI]K[IM][GV][RP][FI][VG][SL]W (SEQ ID NO: 690); an amino acid sequence MOTIF 23 having at least 90% sequence identity to the amino acid sequence as represented by the formula TLTN[EQ]PSE[EQDH]F (SEQ ID NO: 691); and an amino acid sequence MOTIF 24 having at least 90% sequence identity to the amino acid sequence as represented by the formula LP[RS]QS[RT]N[IV]SF (SEQ ID NO: 692).

In some embodiments the nucleic acid molecule encodes a PtIP-83 polypeptide comprises an amino acid sequence MOTIF selected from: an amino acid sequence MOTIF 1 as represented by an amino acid sequence of the formula MP[DE]MP[ST][ED]ADWSIFVNE[IVL]EAVAEGMPT-EVSEVP[AVIL]W[KR]AKCKN[MVIL]AAL GREM[SCT]I (SEQ ID NO: 693); an amino acid sequence MOTIF 2 as represented by an amino acid sequence of the formula PQLQYRMYG[NS]LI[KRNQ]QMAQVAQNYD[QRNK][ED]FK[QRNK][FL][KR]LFI[IAVL]QNQI[L FIV]GSYLL[QEND]QN[KR]AF (SEQ ID NO: 694); an amino acid sequence MOTIF 3 as represented by an amino acid sequence of the formula N[TKSR]FMQMTPFT[RHK]WR-LRLSASA[SPKATR]EN[AKR][EG]LAFPTATA[PLIV]DSTT[EQ ND][IVL][VAIL]ITFHVTAIR (SEQ ID NO: 695); an amino acid sequence MOTIF 4 as represented by an amino acid sequence of the formula [DNQE]FTSRHWK[GDE]IPV[SNTQ]LLLDG[EGD]DWEFEIPVQ[AG] GMSSFP (SEQ ID NO: 696); an amino acid sequence MOTIF 5 as represented by an amino acid sequence of the formula IIHQP[SAT]T[RQKN][ST]G[ITLVS][VIL]YILLQGST[IVL]FHDRRR[DE][EQDN]V[MLIV]T[FP]QA A[DAVEIL]PLN[FY][QHN]YAYRLDTG (SEQ ID NO: 697); an amino acid sequence MOTIF 6 as represented by an amino acid sequence of the formula S[HQN]ADR-LAAIQP[AVIL][DN]LTN[HYF]LEMAT[HQN]MDMRTT[RSKT][MILV]L[ILV]GLLN[M ILV][LMIV]RIQNAAL[MRILVK]YEY (SEQ ID NO: 698); an amino acid sequence MOTIF 7 as represented by an amino acid sequence of the formula [VLI]D[RQKN]VEFSEVM-VIHRMYV[N]RL[SAT]DL[NDQE]V[GA][EQND]L[PED]GA[EGD][RK]VKR[VLI]YV[FLIV]ADWE (SEQ ID NO: 699); an amino acid sequence MOTIF 8 as represented by an amino acid sequence of the formula A[DE]RELQMESFH[SAT]AVISQ[RK]R[QGEND]EL[NDQE][TDSE][ATS][IFLV]AKM[DE]R[LMI V]SLQMEEE[NSDQET][RGK]AMEQA[QRNK]KEM (SEQ ID NO: 700); an amino acid sequence MOTIF 9 as represented by an amino acid sequence of the formula F[VLI]TAGATAPGA[AVIL]ASAGQAV[SNTQ]IAGQAAQ[AG]LRRVVEILE[GQN]LEAVMEVVA A[VIL]K (SEQ ID NO: 701); an amino acid sequence MOTIF 10 as represented by an amino acid sequence of the formula D[GDE][MA][NKQK]WG[ITLVS]Y[IVL][YH][GA]E[KERD]V[EQND][RVLKI]SPL[LYFIV][PNQ][S NGTQ][NWQ][ASPT][IYLV]L[AGVIL]V[WED]A[DQNE]R[CST][TISLV]IT[SAT]A[RFMK]HN[HV TILS][VFIL][NDQE][AERDK]PG[RWK][IVL][IRLVK] (SEQ ID NO: 702); an amino acid sequence MOTIF 11 as represented by an amino acid sequence of the formula [KVRIL][VKRIL][CA][RGCK][PHY]PSP[DE][MILV][MVIL]SAV[AG][EVDIL]HA[LINVQ]WL[NSQ T][DKER]VLL[QRNK]VVQ[KNRQ]ES[QHN][LMIV]QGT[AED][PSAT]YNECLALLGR (SEQ ID NO: 703); an amino acid sequence MOTIF 12 as represented by an amino acid sequence of the formula [PNQ]T[EQDN]LT[VATILS]WPL[GRK]MDTV[AG][NDQE]LLI[ATS][QHN]E[NSQT]AAL[VLSIT]GL[ITMALVS]QLG[PQN][SPT]S (SEQ ID NO: 704); an amino acid sequence MOTIF 13 as represented by an amino acid sequence of the formula [RLCKIV][DLWKEIVR][QNPRK][MTP][HQR][MILV]PGSVTVI[IVL]LCRLLQFP[ITLVS][DGE]G[SRTK][QFRNK][AST][TADES][TWS] (SEQ ID NO: 705); an amino acid sequence MOTIF 14 as represented by an amino acid sequence of the formula [TA][SGVTIL][ILV]PV[ED]WTDP[SNTQ]IL[LMIV]GMQT[TS]V[LHIV]IAEL (SEQ ID NO: 706); an amino acid sequence MOTIF 15 as represented by an amino acid sequence of the formula EGLR[EQND]FQN[REKD]QVA[RNKQ]A[VLI]FAVL[KSRT][AST]VA[MQN]I[AG] (SEQ ID NO: 707); an amino acid sequence MOTIF 16 as represented by an amino acid sequence of the formula W[TS]RVRIRHLEM[QHN]F[AVIL][QKNR]E[AST][SMT][GNQ] (SEQ ID NO: 708); an amino acid sequence MOTIF 17 as represented by an amino acid sequence of the formula Q[IMLV]S[EQND]LQY[ED]IWVQG[LMIV][MLIV]RD[IMLV]A (SEQ ID NO: 709); an amino acid sequence MOTIF 18 as represented by an amino acid sequence of the formula TFTLGSGVT-GITSMHGEPSLDPWNGVSLDSASPTAF (SEQ ID NO: 663); an amino acid sequence MOTIF 19 as represented by an amino acid sequence of the formula [MLVI]DY[SKTR][TSKR]L[YF][REKD]DLNQIS (SEQ ID NO: 710); an amino acid sequence MOTIF 20 as represented by an amino acid sequence of the formula L[RHQKN]L[PTS]FM[QKN-R]LHA[RITKLVS][VQLIN][IRLVK]E[QERNDK][NFQ][VRILK][KWSR T][SETD] (SEQ ID NO: 711); an amino acid sequence MOTIF 21 as represented by an amino acid sequence of the formula V[DNQE][SAT]L[ED]QV[GST][QHN][ILV]V[GDE]AP (SEQ ID NO: 712); an amino acid sequence MOTIF 22 as represented by an amino acid sequence of the formula [IVL][EQHND][CAST][VAIL][M-ILV]K[IMLV][GVIL][RPK][FILV][VGIL][SLTIV]VV (SEQ ID NO: 713); an amino acid sequence MOTIF 23 as represented by an amino acid sequence of the formula TLTN[EQDN]PSE[EQDHN]F (SEQ ID NO: 714); and an amino acid sequence MOTIF 24 as represented by an amino acid sequence of the formula LP[RSKT]QS[RTKS]N[IVL]SF (SEQ ID NO: 715).

In some embodiments the nucleic acid molecule encodes a PtIP-83 polypeptide comprises an amino acid sequence MOTIF selected from: an amino acid sequence MOTIF 1 having at least 90% sequence identity to the amino acid sequence as represented by the formula MP[DE]MP[ST][ED]ADWSIFVNE[IVL]EAVAEGMPTEVSEVP[AVIL]W[KR]AKCKN[MVIL]AAL GREM[SCT]I (SEQ ID NO: 693); an amino acid sequence MOTIF 2 having at least 90% sequence identity to the amino acid sequence as represented by the formula PQLQYRMYG[NS]LI[KRNQ]QMAQVAQNYD[QRNK][ED]FK[QRNK][FL][KR]LFI[IAVL]QNQI[L FIV]GSYLL[QEND]QN[KR]AF (SEQ ID NO: 694); an amino acid sequence MOTIF 3 having at least 90% sequence identity to the amino acid sequence as represented by the formula N[TKSR]FMQMTPFT[RHK]WRLRLSASA[SPKATR]EN[AKR][EG]LAFPTATA[PLIV]DSTT[EQ ND][IVL][VAIL]ITFHVTAIR (SEQ ID NO: 695); an amino acid sequence MOTIF 4 having at least 90% sequence identity to the amino acid sequence as represented by the formula [DNQE]FTSRHWK[GDE]IPV[SNTQ]LLLDG[EGD]DWEFEIPVQ[AG]GMSSFP (SEQ ID NO: 696); an amino acid sequence MOTIF 5 having at least 90% sequence identity to the amino acid sequence as represented by the formula IIHQP[SAT]T[RQKN][ST]G[ITLVS][VIL]YILLQGST[IVL]FHDRRR[DE][EQDN]V[MLIV]T[FP]QA A[DAVEIL]PLN[FY][QHN]YAY-RLDTG (SEQ ID NO: 697); an amino acid sequence MOTIF 6 having at least 90% sequence identity to the amino acid sequence as represented by the formula S[HQN]ADR-LAAIQP[AVIL][DN]LTN[HYF]LEMAT[HQN]MDMRTT[RSKT][MILV]L[ILV]GLLN[M ILV][LMIV]RIQNAAL[MRILVK]YEY (SEQ ID NO: 698); an amino acid sequence MOTIF 7 having at least 90% sequence identity to the amino acid sequence as represented by the formula [VLI]D[RQKN]VEFSEVMVIHRMYV[N]RL[SAT]DL[NDQE]V[GA][EQND]L[PED]GA[EGD][RK]VKR[VLI]YV[FLIV]ADWE (SEQ ID NO: 699); an amino acid sequence MOTIF 8 having at least 90% sequence identity to the amino acid sequence as represented by the formula A[DE]RELQMESFH[SAT]AVISQ[RK]R[QGEND]EL[NDQE][TDSE][ATS][IFLV]AKM[DE]R[LMI V]SLQMEEE[NSDQET][RGK]AMEQA[QRNK]KEM (SEQ ID NO: 700); an amino acid sequence MOTIF 9 having at least 90% sequence identity to the amino acid sequence as represented by the formula F[VLI]TAGATAP-GA[AVIL]ASAGQAV[SNTQ]IAGQAAQ[AG]LRRV-VEILE[GQN]LEAVMEVVA A[VIL]K (SEQ ID NO: 701); an amino acid sequence MOTIF 10 having at least 90% sequence identity to the amino acid sequence as represented by the formula D[GDE][MA][NKQK]WG[ITLVS]Y[IVL][YH][GA]E[KERD]V[EQND][RVLKI]SPL[LYFIV][PNQ][S NGTQ][NWQ][ASPT][IYLV]L[AGVIL]V[WED]A[DQNE]R[CST][TISLV]IT[SAT]A[RFMK]HN[HV TILS][VFIL][NDQE][AERDK]PG[RWK][IVL][IRLVK] (SEQ ID NO: 702); an amino acid sequence MOTIF 11 having at least 90% sequence identity to the amino acid sequence as represented by the formula [KVRIL][VKRIL][CA][RGCK][PHY]PSP[DE][MILV][MVIL]SAV[AG][EVDIL]HA[LINVQ]WL[NSQ T][DKER]VLL[QRNK]VVQ[KNRQ]ES[QHN][LMIV]QGT[AED][PSAT]YNECLALLGR (SEQ ID NO: 703); an amino acid sequence MOTIF 12 having at least 90% sequence identity to the amino acid sequence as represented by the formula [PNQ]T[EQDN]LT[VATILS]WPL[GRK]MDTV[AG][NDQE]LLI[ATS][QHN]E[NSQT]AAL[VLSIT]GL[IT-MALVS]QLG[PQN][SPT]S (SEQ ID NO: 704); an amino acid sequence MOTIF 13 having at least 90% sequence identity to the amino acid sequence as represented by the formula [RLCKIV][DLWKEIVR][QNPRK][MTP][HQR][MILV]PGSVTVI[IVL]LCRLLQFP[ITLVS][DGE]G[SRTK][QFRNK][AST][TADES][TWS] (SEQ ID NO: 705); an amino acid sequence MOTIF 14 having at least 90% sequence identity to the amino acid sequence as represented by the formula [TA][SGVTIL][ILV]PV[ED]WTDP[SNTQ]IL[LMIV]GMQT[TS]V[LHIV]IAEL (SEQ ID NO: 706); an amino acid sequence MOTIF 15 having at least 90% sequence identity to the amino acid sequence as represented by the formula EGLR[EQND]FQN[REKD]Q-VA[RNKQ]A[VLI]FAVL[KSRT][AST]VA[MQN]I[AG] (SEQ ID NO: 707); an amino acid sequence MOTIF 16 having at least 90% sequence identity to the amino acid sequence as represented by the formula W[TS]RVRIRHLEM[QHN]F[AVIL][QKNR]E[AST][SMT][GNQ] (SEQ ID NO: 708); an amino acid sequence MOTIF 17 having at least 90% sequence identity to the amino acid sequence as represented by the formula Q[IMLV]S[EQND]LQY[ED]IWVQG[LMIV][MLIV]RD[IMLV]A (SEQ ID NO: 709); an amino acid sequence MOTIF 18 having at least 90% sequence identity to the amino acid sequence as represented by the formula TFTLGSGVTGITSMH-GEPSLDPWNGVSLDSASPTAF (SEQ ID NO: 663); an amino acid sequence MOTIF 19 having at least 90% sequence identity to the amino acid sequence as represented by the formula [MLVI]DY[SKTR][TSKR]L[YF][REKD]DLNQIS (SEQ ID NO: 710); an amino acid sequence MOTIF 20 having at least 90% sequence identity to the amino acid sequence as represented by the formula L[RHQKN]L[PTS]FM[QKNR]LHA[RITKLVS][VQLIN][IRLVK]E[QERNDK][NFQ][VRILK][KWSR T][SETD] (SEQ ID NO: 711); an amino acid sequence MOTIF 21 having at least 90% sequence identity to the amino acid sequence as represented by the formula V[DNQE][SAT]L[ED]QV[GST][QHN][ILV]V[GDE]AP (SEQ ID NO: 712); an amino acid sequence MOTIF 22 having at least 90% sequence identity to the amino acid sequence as represented by the formula [IVL][EQHND][CAST][VAIL][MILV]K[IMLV][GVIL][RPK][FILV][VGIL][SLTIV]W (SEQ ID NO: 713); an amino acid sequence MOTIF 23 having at least 90% sequence identity to the amino acid sequence as represented by the formula TLTN[EQDN]PSE[EQDHN]F (SEQ ID NO: 714); and an amino acid sequence MOTIF 24 having at least 90% sequence identity to the amino acid sequence as represented by the formula LP[RSKT]QS[RTK-S]N[IVL]SF (SEQ ID NO: 715).

In some embodiments the nucleic acid molecule encodes a PtIP-83 polypeptide comprising, sequentially from the N-terminus to the C-terminus, an amino acid sequence MOTIF selected from: MOTIF 19 (SEQ ID NO: 664, SEQ ID NO: 687 or SEQ ID NO: 710), MOTIF 7 (SEQ ID NO: 652, SEQ ID NO: 676 or SEQ ID NO: 699), MOTIF 13 (SEQ ID NO: 658, SEQ ID NO: 682 or SEQ ID NO: 705), MOTIF 20 (SEQ ID NO: 665, SEQ ID NO: 688 or SEQ ID NO: 711), MOTIF 10 (SEQ ID NO: 655, SEQ ID NO: 679 or SEQ ID NO: 702), MOTIF 18 (SEQ ID NO: 663), MOTIF 24 (SEQ ID NO: 669, SEQ ID NO: 692 or SEQ ID NO: 715), MOTIF 14 (SEQ ID NO: 659, SEQ ID NO: 683 or SEQ ID NO: 706), MOTIF 11 (SEQ ID NO: 656, SEQ ID NO: 680 or SEQ ID NO: 703), MOTIF 22 (SEQ ID NO: 667, SEQ ID NO: 690 or SEQ ID NO: 713), MOTIF 2 (SEQ ID NO: 647, SEQ ID NO: 671 or SEQ ID NO: 694), MOTIF 8 (SEQ ID NO: 653, SEQ ID NO: 677 or SEQ ID NO: 700), MOTIF 15 (SEQ ID NO: 660, SEQ ID NO: 684 or SEQ ID NO: 707), MOTIF 9 (SEQ ID NO: 654, SEQ ID NO: 678 or SEQ ID NO: 701), MOTIF 21 (SEQ ID NO: 666, SEQ ID NO: 689 or SEQ ID NO: 712), MOTIF 1 (SEQ ID NO: 646, SEQ ID NO: 670 or SEQ ID NO: 693), MOTIF 17 (SEQ ID NO: 662, SEQ ID NO: 686 or SEQ ID NO: 709), MOTIF 6 (SEQ ID NO: 651, SEQ ID NO: 675 or SEQ ID NO: 698), MOTIF 12 (SEQ ID NO: 657, SEQ ID NO: 681 or SEQ ID NO: 704), MOTIF 4 (SEQ ID NO: 649, SEQ ID NO: 673 or SEQ ID NO: 696), MOTIF 16 (SEQ ID NO: 661, SEQ ID NO: 685 or SEQ ID NO: 708), MOTIF 5 (SEQ ID NO: 650, SEQ ID NO: 674 or SEQ ID NO: 697), MOTIF 23 (SEQ ID NO: 668, SEQ ID NO: 691 or SEQ ID NO: 714), and MOTIF 3 (SEQ ID NO: 648, SEQ ID NO: 672 or SEQ ID NO: 695).

In some embodiments the nucleic acid molecule encodes a PtIP-83 polypeptide comprising, sequentially from the N-terminus to the C-terminus, an amino acid sequence MOTIF selected from: MOTIF 19 (SEQ ID NO: 664, SEQ ID NO: 687 or SEQ ID NO: 710), MOTIF 7 (SEQ ID NO: 652, SEQ ID NO: 676 or SEQ ID NO: 699), MOTIF 13 (SEQ ID NO: 658, SEQ ID NO: 682 or SEQ ID NO: 705), MOTIF 20 (SEQ ID NO: 665, SEQ ID NO: 688 or SEQ ID NO: 711), MOTIF 14 (SEQ ID NO: 659, SEQ ID NO: 683 or SEQ ID NO: 706), MOTIF 2 (SEQ ID NO: 647, SEQ ID NO: 671 or SEQ ID NO: 694), MOTIF 8 (SEQ ID NO: 653, SEQ ID NO: 677 or SEQ ID NO: 700), MOTIF 15 (SEQ ID NO: 660, SEQ ID NO: 684 or SEQ ID NO: 707), MOTIF 9 (SEQ ID NO: 654, SEQ ID NO: 678 or SEQ ID NO: 701), MOTIF 21 (SEQ ID NO: 666, SEQ ID NO: 689 or SEQ ID NO: 712), MOTIF 1 (SEQ ID NO: 646, SEQ ID NO: 670 or SEQ ID NO: 693), MOTIF 17 (SEQ ID NO: 662, SEQ ID NO: 686 or SEQ ID NO: 709), MOTIF 6 (SEQ ID NO: 651, SEQ ID NO: 675 or SEQ ID NO: 698), MOTIF 12 (SEQ ID NO: 657, SEQ ID NO: 681 or SEQ ID NO: 704), MOTIF 4 (SEQ ID NO: 649, SEQ ID NO: 673 or SEQ ID NO: 696), MOTIF 16 (SEQ ID NO: 661, SEQ ID NO: 685 or SEQ ID NO: 708), MOTIF 5 (SEQ ID NO: 650, SEQ ID NO: 674 or SEQ ID NO: 697), MOTIF 23 (SEQ ID NO: 668, SEQ ID NO: 691 or SEQ ID NO: 714), and MOTIF 3 (SEQ ID NO: 648, SEQ ID NO: 672 or SEQ ID NO: 695).

In some embodiments the nucleic acid molecule encodes a PtIP-83 polypeptide comprising, sequentially from the N-terminus to the C-terminus, the amino acid sequence motifs: MOTIF 19 (SEQ ID NO: 664, SEQ ID NO: 687 or SEQ ID NO: 710), MOTIF 7 (SEQ ID NO: 652, SEQ ID NO: 676 or SEQ ID NO: 699), MOTIF 13 (SEQ ID NO: 658, SEQ ID NO: 682 or SEQ ID NO: 705), MOTIF 20 (SEQ ID NO: 665, SEQ ID NO: 688 or SEQ ID NO: 711), MOTIF 10 (SEQ ID NO: 655, SEQ ID NO: 679 or SEQ ID NO: 702), MOTIF 18 (SEQ ID NO: 663), MOTIF 24 (SEQ ID NO: 669, SEQ ID NO: 692 or SEQ ID NO: 715), MOTIF 14 (SEQ ID NO: 659, SEQ ID NO: 683 or SEQ ID NO: 706), MOTIF 11 (SEQ ID NO: 656, SEQ ID NO: 680 or SEQ ID NO: 703), MOTIF 22 (SEQ ID NO: 667, SEQ ID NO: 690 or SEQ ID NO: 713), MOTIF 2 (SEQ ID NO: 647, SEQ ID NO: 671 or SEQ ID NO: 694), MOTIF 8 (SEQ ID NO: 653, SEQ ID NO: 677 or SEQ ID NO: 700), MOTIF 15 (SEQ ID NO: 660, SEQ ID NO: 684 or SEQ ID NO: 707), MOTIF 9 (SEQ ID NO: 654, SEQ ID NO: 678 or SEQ ID NO: 701), MOTIF 21 (SEQ ID NO: 666, SEQ ID NO: 689 or SEQ ID NO: 712), MOTIF 1 (SEQ ID NO: 646, SEQ ID NO: 670 or SEQ ID NO: 693), MOTIF 17 (SEQ ID NO: 662, SEQ ID NO: 686 or SEQ ID NO: 709), MOTIF 6 (SEQ ID NO: 651, SEQ ID NO: 675 or SEQ ID NO: 698), MOTIF 12 (SEQ ID NO: 657, SEQ ID NO: 681 or SEQ ID NO: 704), MOTIF 4 (SEQ ID NO: 649, SEQ ID NO: 673 or SEQ ID NO: 696), MOTIF 16 (SEQ ID NO: 661, SEQ ID NO: 685 or SEQ ID NO: 708), MOTIF 5 (SEQ ID NO: 650, SEQ ID NO: 674 or SEQ ID NO: 697), MOTIF 23 (SEQ ID NO: 668, SEQ ID NO: 691 or SEQ ID NO: 714), and MOTIF 3 (SEQ ID NO: 648, SEQ ID NO: 672 or SEQ ID NO: 695).

In some embodiments the nucleic acid molecule encodes a PtIP-83 polypeptide comprising, sequentially from the N-terminus to the C-terminus, the amino acid sequence motifs: MOTIF 19 (SEQ ID NO: 664, SEQ ID NO: 687 or SEQ ID NO: 710), MOTIF 7 (SEQ ID NO: 652, SEQ ID NO: 676 or SEQ ID NO: 699), MOTIF 13 (SEQ ID NO: 658, SEQ ID NO: 682 or SEQ ID NO: 705), MOTIF 20 (SEQ ID NO: 665, SEQ ID NO: 688 or SEQ ID NO: 711), MOTIF 14 (SEQ ID NO: 659, SEQ ID NO: 683 or SEQ ID NO: 706), MOTIF 2 (SEQ ID NO: 647, SEQ ID NO: 671 or SEQ ID NO: 694), MOTIF 8 (SEQ ID NO: 653, SEQ ID NO: 677 or SEQ ID NO: 700), MOTIF 15 (SEQ ID NO: 660, SEQ ID NO: 684 or SEQ ID NO: 707), MOTIF 9 (SEQ ID NO: 654, SEQ ID NO: 678 or SEQ ID NO: 701), MOTIF 21 (SEQ ID NO: 666, SEQ ID NO: 689 or SEQ ID NO: 712), MOTIF 1 (SEQ ID NO: 646, SEQ ID NO: 670 or SEQ ID NO: 693), MOTIF 17 (SEQ ID NO: 662, SEQ ID NO: 686 or SEQ ID NO: 709), MOTIF 6 (SEQ ID NO: 651, SEQ ID NO: 675 or SEQ ID NO: 698), MOTIF 12 (SEQ ID NO: 657, SEQ ID NO: 681 or SEQ ID NO: 704), MOTIF 4 (SEQ ID NO: 649, SEQ ID NO: 673 or SEQ ID NO: 696), MOTIF 16 (SEQ ID NO: 661, SEQ ID NO: 685 or SEQ ID NO: 708), MOTIF 5 (SEQ ID NO: 650, SEQ ID NO: 674 or SEQ ID NO: 697), MOTIF 23 (SEQ ID NO: 668, SEQ ID NO: 691 or SEQ ID NO: 714), and MOTIF 3 (SEQ ID NO: 648, SEQ ID NO: 672 or SEQ ID NO: 695).

In some embodiments the nucleic acid molecule encodes a PtIP-83 polypeptide comprising sequentially from the N-terminus to the C-terminus: a Region A of between about 200 to about 300 amino acids in length comprising an amino acid sequence MOTIF of: MOTIF 19 (SEQ ID NO: 664, SEQ ID NO: 687 or SEQ ID NO: 710), MOTIF 7 (SEQ ID NO: 652, SEQ ID NO: 676 or SEQ ID NO: 699), MOTIF 13 (SEQ ID NO: 658, SEQ ID NO: 682 or SEQ ID NO: 705), MOTIF 20 (SEQ ID NO: 665, SEQ ID NO: 688 or SEQ ID NO: 711), MOTIF 10 (SEQ ID NO: 655, SEQ ID NO: 679 or SEQ ID NO: 702), MOTIF 18 (SEQ ID NO: 663), MOTIF 24 (SEQ ID NO: 669, SEQ ID NO: 692 or SEQ ID NO: 715), and/or MOTIF 14 having a predominantly nonconserved secondary structure; a Region B of between about 380 to about 465 amino acids in length comprising an amino acid sequence MOTIF of MOTIF 22 (SEQ ID NO: 667, SEQ ID NO: 690 or SEQ ID NO: 713), MOTIF 2 (SEQ ID NO: 647, SEQ ID NO: 671 or SEQ ID NO: 694), MOTIF 8 (SEQ ID NO: 653, SEQ ID NO: 677 or SEQ ID NO: 700), MOTIF 15 (SEQ ID NO: 660, SEQ ID NO: 684 or SEQ ID NO: 707), MOTIF 9 (SEQ ID NO: 654, SEQ ID NO: 678 or SEQ ID NO: 701), MOTIF 21 (SEQ ID NO: 666, SEQ ID NO: 689 or SEQ ID NO: 712), MOTIF 1 (SEQ ID NO: 646, SEQ ID NO: 670 or SEQ ID NO: 693), MOTIF 17 (SEQ ID NO: 662, SEQ ID NO: 686 or SEQ ID NO: 709), MOTIF 6 (SEQ ID NO: 651, SEQ ID NO: 675 or SEQ ID NO: 698), and/or MOTIF 12 and having a predominately alpha helical structure; and a Region C of between about 150 to about 180 amino acids in length comprising an amino acid sequence MOTIF of MOTIF 16 (SEQ ID NO: 661, SEQ ID NO: 685 or SEQ ID NO: 708), MOTIF 5 (SEQ ID NO: 650, SEQ ID NO: 674 or SEQ ID NO: 697), MOTIF 23 (SEQ ID NO: 668, SEQ ID NO: 691 or SEQ ID NO: 714), and/or MOTIF 3 (SEQ ID NO: 648, SEQ ID NO: 672 or SEQ ID NO: 695), having a consensus secondary structure comprising predominately beta strand structure.

In some embodiments the PtIP-83 polypeptide comprises an amino acid sequence MOTIF at the positions as shown in Table 2.

In some embodiments the nucleic acid molecule encodes a PtIP-83 polypeptide comprising sequentially from the N-terminus to the C-terminus: a Region A of between about 200 to about 300 amino acids in length having a predominantly nonconserved secondary structure; a Region B of between about 380 to about 465 amino acids in length having a consensus secondary structure comprising 8 to 10 segments of predominately alpha helical structure; and a Region C of between about 150 to about 180 amino acids in length having a consensus secondary structure comprising 6 to 8 segments of predominately beta strand structure. As used herein "predominantly nonconserved secondary structure" means that the regions of secondary structure don't consistently align within the family of PtIP polypeptides. As used herein "predominately alpha helical structure" means that secondary structure prediction may have one or more gap of between 1 to 6 amino acids of coil and/or beta strand structure intervening in the alpha helix structure. As used herein "predominately beta strand structure" means that secondary structure prediction may have one or more gap of between 1 to 6 amino acids of coil and/or alpha helix structure intervening in the beta strand structure. In some embodiments the secondary structure is generated by the PSIPRED, top ranked secondary structure prediction method (Jones D T. (1999) *J. Mol. Biol.* 292: 195-202).

In some embodiments the nucleic acid molecule encodes a PtIP-83 polypeptide comprising sequentially from the N-terminus to the C-terminus: a Region A of between about 200 to about 300 amino acids in length having a predominantly nonconserved secondary structure; a Region B of between about 380 to about 465 amino acids in length having a consensus secondary structure comprising nine segments of predominately alpha helical structure; and a Region C of between about 150 to about 180 amino acids in length having a consensus secondary structure comprising seven segments of predominately beta strand structure.

In some embodiments the nucleic acid molecule encodes a PtIP-83 polypeptide comprising sequentially from the N-terminus to the C-terminus: a Region A of between about 200 to about 300 amino acids in length having a predominantly nonconserved secondary structure, wherein the Region A comprises a conserved beta strand 1 (β1a) of between about 4 and about 12 amino acids in length within about amino acid residue 30 to about amino acid residue 130 from the N-terminus of the PtIP-83 polypeptide; a Region B of between about 380 to about 465 amino acids in length having a consensus secondary structure comprising nine segments of predominately alpha helical structure; and a Region C of between about 150 to about 180 amino acids in length having a consensus secondary structure comprising seven segments of predominately beta strand structure.

In some embodiments the nucleic acid molecule encodes a PtIP-83 polypeptide comprising sequentially from the N-terminus to the C-terminus: a Region A of between about 200 to about 300 amino acids in length having a flexible consensus secondary structure, wherein the Region A comprises a conserved beta strand 1 (β1a) of between about 4 and about 12 amino acids in length, a coil of between about 3 and about 18 amino acids in length and a beta strand 2 (β1b) of between about 4 and about 32 amino acids in length, within about amino acid residue 50 to about amino acid residue 165 from the N-terminus of the PtIP-83 polypeptide; a Region B of between about 380 to about 465 amino acids in length having a consensus secondary structure comprising nine segments of predominately alpha helical structure; and a Region C of between about 150 to about 180 amino acids in length having a consensus secondary structure comprising seven segments of predominately beta strand structure.

In some embodiments the nucleic acid molecule encodes a PtIP-83 polypeptide comprising sequentially from the N-terminus to the C-terminus: a Region A of between about 200 to about 300 amino acids in length having a predominantly nonconserved secondary structure; a Region B of between about 380 to about 465 amino acids in length having a consensus secondary structure comprising sequentially: i) an alpha helix-1 of between about 10 and about 26 amino acids in length; ii) a coil-1 of between about 2 and about 8 amino acids in length flanked by alpha helix-1 and alpha helix-2; iii) an alpha helix-2 of between about 15 and about 24 amino acids in length; iv) a coil-2 of between about 4 and about 14 amino acids in length flanked by alpha helix-2 and alpha helix-3; v) an alpha helix 3 of between about 15 and about 27 amino acids in length; vi) a coil-3 of between about 11 and about 13 amino acids in length flanked by alpha helix-3 and alpha helix-4; vii) an alpha helix-4 of about 24 180 amino acids in length; viii) a coil-4 of between about 4 and about 5 amino acids in length flanked by alpha helix-4 and alpha helix-5; ix) an alpha helix-5 of between about 50 and about 54 amino acids in length; x) a coil-5 of between about 11 and about 17 amino acids in length flanked by alpha helix-5 and alpha helix-6; xi) an alpha helix-6 of between about 15 and about 16 amino acids in length; xii) a coil-6 of between about 6 and about 9 amino acids in length flanked by alpha helix-6 and alpha helix-7; xiii) an alpha helix-7 of between about 49 and about 55 amino acids in length; xiv) a coil-7 of between about 3 and about 8 amino acids in length flanked by alpha helix-7 and alpha helix-8; xv) an alpha helix-8 of between about 33 and about 36 amino acids in length; xvi) a coil-8 of between about 14 and about 16 amino acids in length flanked by alpha helix-8 and alpha helix-9; xvii) an alpha helix-9 of between about 16 and about 23 amino acids in length; xviii) a coil-9 of between about 21 and about 28 amino acids in length flanked by alpha helix-9 and Region C; and a Region C of between about 150 to about 180 amino acids in length having a consensus secondary structure comprising seven segments of predominately beta strand structure.

In some embodiments the nucleic acid molecule encodes a PtIP-83 polypeptide comprising sequentially from the N-terminus to the C-terminus: a Region A of between about 200 to about 300 amino acids in length having a predominantly nonconserved secondary structure; a Region B of between about 380 to about 465 amino acids in length having a consensus secondary structure comprising nine segments of predominately alpha helical structure; and a Region C of between about 150 to about 180 amino acids in length having a consensus secondary structure comprising sequentially: i) a beta strand-1 (β1) of between about 3 amino acids and about 5 amino acids in length; ii) a coil of between about 13 amino acids and about 17 amino acids in length; iii) a beta strand-2 (β2) of between about 7 amino acids and about 11 amino acids in length; iv) a coil of between about 17 amino acids and about 23 amino acids in length; v) a beta strand-3 (β3) of between about 5 amino acids and about 7 amino acids in length; vi) a coil of between about 12 amino acids and about 14 amino acids in length; vii) a beta strand-4 (β4) of between about 5 amino acids and about 6 amino acids in length; viii) a coil of between about 2 amino acids and about 7 amino acids in length; ix) a beta strand-5 (β5) of between about 5 amino acids and about 7 amino acids in length; x) a coil of between about 26 amino acids and about 28 amino acids in length; xi) a beta strand-6 (β6) of between about 5 amino acids and about 7 amino acids in length; xii) a coil of between about 16 amino acids and about 20 amino acids in length; and xiii) a beta strand-1 (β7) of between about 13 amino acids and about 17 amino acids in length.

In some embodiments the nucleic acid molecule encodes a PtIP-83 polypeptide comprising sequentially from the N-terminus to the C-terminus: a Region A of between about 200 to about 300 amino acids in length having a predominantly nonconserved secondary structure; a Region B of between about 380 to about 465 amino acids in length having a consensus secondary structure comprising sequentially: i) an alpha helix-1 of between about 10 and about 26 amino acids in length; ii) a coil-1 of between about 2 and about 8 amino acids in length flanked by alpha helix-1 and alpha helix-2; iii) an alpha helix-2 of between about 15 and about 24 amino acids in length; iv) a coil-2 of between about 4 and about 14 amino acids in length flanked by alpha helix-2 and alpha helix-3; v) an alpha helix 3 of between about 15 and about 27 amino acids in length; vi) a coil-3 of between about 11 and about 13 amino acids in length flanked by alpha helix-3 and alpha helix-4; vii) an alpha helix-4 of about 24 180 amino acids in length; viii) a coil-4 of between about 4 and about 5 amino acids in length flanked by alpha helix-4 and alpha helix-5; ix) an alpha helix-5 of between about 50 and about 54 amino acids in length; x) a coil-5 of between about 11 and about 17 amino acids in length flanked by alpha helix-5 and alpha helix-6; xi) an alpha helix-6 of between about 15 and about 16 amino acids in length; xii) a coil-6 of between about 6 and about 9 amino acids in length flanked by alpha helix-6 and alpha helix-7; xiii) an alpha helix-7 of between about 49 and about 55 amino acids in length; xiv) a coil-7 of between about 3 and about 8 amino acids in length flanked by alpha helix-7 and alpha helix-8; xv) an alpha helix-8 of between about 33 and about 36 amino acids in length; xvi) a coil-8 of between about 14 and about 16 amino acids in length flanked by alpha helix-8 and alpha helix-9; xvii) an alpha helix-9 of between about 16 and about 23 amino acids in length; xviii) a coil-9 of between about 21 and about 28 amino acids in length flanked by alpha helix-9 and Region C; and a Region C of between about 150 to about 180 amino acids in length having a consensus secondary structure comprising sequentially: i) a beta strand-1 ($\beta$1) of between about 3 amino acids and about 5 amino acids in length; ii) a coil of between about 13 amino acids and about 17 amino acids in length; iii) a beta strand-2 ($\beta$2) of between about 7 amino acids and about 11 amino acids in length; iv) a coil of between about 17 amino acids and about 23 amino acids in length; v) a beta strand-3 ($\beta$3) of between about 5 amino acids and about 7 amino acids in length; vi) a coil of between about 12 amino acids and about 14 amino acids in length; vii) a beta strand-4 ($\beta$4) of between about 5 amino acids and about 6 amino acids in length; viii) a coil of between about 2 amino acids and about 7 amino acids in length; ix) a beta strand-5 ($\beta$5) of between about 5 amino acids and about 7 amino acids in length; x) a coil of between about 26 amino acids and about 28 amino acids in length; xi) a beta strand-6 ($\beta$6) of between about 5 amino acids and about 7 amino acids in length; xii) a coil of between about 16 amino acids and about 20 amino acids in length; and xiii) a beta strand-1 ($\beta$7) of between about 13 amino acids and about 17 amino acids in length.

In some embodiments the nucleic acid molecule encodes a PtIP-83 polypeptide comprising sequentially from the N-terminus to the C-terminus: a Region A of between about 200 to about 300 amino acids in length having a flexible consensus secondary structure, wherein the Region A comprises a conserved beta strand 1 ($\beta$1a) of between about 4 and about 12 amino acids in length within about amino acid residue 30 to about amino acid residue 130 from the N-terminus of the PtIP-83 polypeptide; a Region B of between about 380 to about 465 amino acids in length having a consensus secondary structure comprising sequentially: i) an alpha helix-1 of between about 10 and about 26 amino acids in length; ii) a coil-1 of between about 2 and about 8 amino acids in length flanked by alpha helix-1 and alpha helix-2; iii) an alpha helix-2 of between about 15 and about 24 amino acids in length; iv) a coil-2 of between about 4 and about 14 amino acids in length flanked by alpha helix-2 and alpha helix-3; v) an alpha helix 3 of between about 15 and about 27 amino acids in length; vi) a coil-3 of between about 11 and about 13 amino acids in length flanked by alpha helix-3 and alpha helix-4; vii) an alpha helix-4 of about 24 180 amino acids in length; viii) a coil-4 of between about 4 and about 5 amino acids in length flanked by alpha helix-4 and alpha helix-5; ix) an alpha helix-5 of between about 50 and about 54 amino acids in length; x) a coil-5 of between about 11 and about 17 amino acids in length flanked by alpha helix-5 and alpha helix-6; xi) an alpha helix-6 of between about 15 and about 16 amino acids in length; xii) a coil-6 of between about 6 and about 9 amino acids in length flanked by alpha helix-6 and alpha helix-7; xiii) an alpha helix-7 of between about 49 and about 55 amino acids in length; xiv) a coil-7 of between about 3 and about 8 amino acids in length flanked by alpha helix-7 and alpha helix-8; xv) an alpha helix-8 of between about 33 and about 36 amino acids in length; xvi) a coil-8 of between about 14 and about 16 amino acids in length flanked by alpha helix-8 and alpha helix-9; xvii) an alpha helix-9 of between about 16 and about 23 amino acids in length; xviii) a coil-9 of between about 21 and about 28 amino acids in length flanked by alpha helix-9 and Region C; and a Region C of between about 150 to about 180 amino acids in length having a consensus secondary comprising sequentially: i) a beta strand-1 ($\beta$1) of between about 3 amino acids and about 5 amino acids in length; ii) a coil of between about 13 amino acids and about 17 amino acids in length; iii) a beta strand-2 ($\beta$2) of between about 7 amino acids and about 11 amino acids in length; iv) a coil of between about 17 amino acids and about 23 amino acids in length; v) a beta strand-3 ($\beta$3) of between about 5 amino acids and about 7 amino acids in length; vi) a coil of between about 12 amino acids and about 14 amino acids in length; vii) a beta strand-4 ($\beta$4) of between about 5 amino acids and about 6 amino acids in length; viii) a coil of between about 2 amino acids and about 7 amino acids in length; ix) a beta strand-5 ($\beta$5) of between about 5 amino acids and about 7 amino acids in length; x) a coil of between about 26 amino acids and about 28 amino acids in length; xi) a beta strand-6 ($\beta$6) of between about 5 amino acids and about 7 amino acids in length; xii) a coil of between about 16 amino acids and about 20 amino acids in length; and xiii) a beta strand-1 ($\beta$7) of between about 13 amino acids and about 17 amino acids in length.

Also provided are nucleic acid molecules that encode transcription and/or translation products that are subsequently spliced to ultimately produce functional PtIP-83 polypeptides. Splicing can be accomplished in vitro or in vivo, and can involve cis- or trans-splicing. The substrate for splicing can be polynucleotides (e.g., RNA transcripts) or polypeptides. An example of cis-splicing of a polynucleotide is where an intron inserted into a coding sequence is removed and the two flanking exon regions are spliced to generate a PtIP-83 polypeptide encoding sequence. An example of trans splicing would be where a polynucleotide is encrypted by separating the coding sequence into two or more fragments that can be separately transcribed and then spliced to form the full-length pesticidal encoding sequence. The use of a splicing enhancer sequence, which can be introduced into a construct, can facilitate splicing either in cis or trans-splicing of polypeptides (U.S. Pat. Nos. 6,365,377 and 6,531,316). Thus, in some embodiments the polynucleotides do not directly encode a full-length PtIP-83 polypeptide, but rather encode a fragment or fragments of a PtIP-83 polypeptide. These polynucleotides can be used to express a functional PtIP-83 polypeptide through a mechanism involving splicing, where splicing can occur at the level of polynucleotide (e.g., intron/exon) and/or polypeptide (e.g., intein/extein). This can be useful, for example, in controlling expression of pesticidal activity, since a functional pesticidal polypeptide will only be expressed if all required fragments are expressed in an environment that permits splicing processes to generate functional product. In another example, introduction of one or more insertion sequences into a polynucleotide can facilitate recombination with a low homology polynucleotide; use of an intron or intein for the insertion sequence facilitates the removal of the intervening sequence, thereby restoring function of the encoded variant.

Nucleic acid molecules that are fragments of these nucleic acid sequences encoding PtIP-83 polypeptides are also encompassed by the embodiments. "Fragment" as used herein refers to a portion of the nucleic acid sequence encoding a PtIP-83 polypeptide. A fragment of a nucleic acid sequence may encode a biologically active portion of a PtIP-83 polypeptide or it may be a fragment that can be used as a hybridization probe or PCR primer using methods disclosed below. Nucleic acid molecules that are fragments of a nucleic acid sequence encoding a PtIP-83 polypeptide comprise at least about 150, 180, 210, 240, 270, 300, 330 or 360, contiguous nucleotides or up to the number of nucleotides present in a full-length nucleic acid sequence encoding a PtIP-83 polypeptide disclosed herein, depending upon the intended use. "Contiguous nucleotides" is used herein to refer to nucleotide residues that are immediately adjacent to one another. Fragments of the nucleic acid sequences of the embodiments will encode protein fragments that retain the biological activity of the PtIP-83 polypeptide and, hence, retain insecticidal activity. "Retains insecticidal activity" is used herein to refer to a polypeptide having at least about 10%, at least about 30%, at least about 50%, at least about 70%, 80%, 90%, 95% or higher of the insecticidal activity of the full-length PtIP-83Aa polypeptide (SEQ ID NO: 1). In some embodiments, the insecticidal activity is Lepidoptera activity. In one embodiment, the insecticidal activity is against a Coleopteran species. In some embodiments, the insecticidal activity is against one or more insect pests of the corn rootworm complex: western corn rootworm, *Diabrotica virgifera*; northern corn rootworm, *D. barberi*: Southern corn rootworm or spotted cucumber beetle; *Diabrotica undecimpunctata howardi*, and the Mexican corn rootworm, *D. virgifera zeae*. In one embodiment, the insecticidal activity is against a *Diabrotica* species.

In some embodiments a fragment of a nucleic acid sequence encoding a PtIP-83 polypeptide encoding a biologically active portion of a protein will encode at least about 15, 20, 30, 50, 75, 100, 125, contiguous amino acids or up to the total number of amino acids present in a full-length PtIP-83 polypeptide of the embodiments. In some embodiments, the fragment is an N-terminal and/or a C-terminal truncation of at least about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34 or more amino acids from the N-terminus and/or C-terminus relative to SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23 or SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769 variants thereof, e.g., by proteolysis, insertion of a start codon, deletion of the codons encoding the deleted amino acids with the concomitant insertion of a stop codon or by insertion of a stop codon in the coding sequence. In some embodiments, the fragments encompassed herein result from the removal of the N-terminal 1, 2, 3, 4, 5, 6, 7, 8, 9, 10, 11, 12, 13, 14, 15, 16, 17, 18, 19, 20, 21, 22, 23, 24, 25 or more amino acids from the N-terminus relative to SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, SEQ ID NO: 769 or variants thereof, e.g., by proteolysis or by insertion of a start codon in the coding sequence.

In some embodiments, the fragments encompassed herein result from the removal of the N-terminal 1, 2, 3, 4, 5, 6, 7, 8, 9, 10, 11, 12, 13, 14 amino acids relative to SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, SEQ ID NO: 769 or variants thereof, e.g., by proteolysis or by insertion of a start codon in the coding sequence.

In some embodiments the PtIP-83 polypeptide is encoded by a nucleic acid sequence sufficiently homologous to the nucleic acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 717, SEQ ID NO: 738, SEQ ID NO: 739, SEQ ID NO: 740, SEQ ID NO: 741, SEQ ID NO: 742, SEQ ID NO: 743, SEQ ID NO: 744, SEQ ID NO: 745, SEQ ID NO: 746, SEQ ID NO: 747, SEQ ID NO: 748, SEQ ID NO: 749, SEQ ID NO: 750, SEQ ID NO: 751, SEQ ID NO: 752 or SEQ ID NO: 753. "Sufficiently homologous" is used herein to refer to an amino acid or nucleic acid sequence that has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence homology compared to a reference sequence using one of the alignment programs described herein using standard parameters. One of skill in the art will recognize that these values can be appropriately adjusted to determine corresponding homology of proteins encoded by two nucleic acid sequences by taking into account codon degeneracy, amino acid similarity, reading frame positioning, and the like.

In some embodiments the sequence homology is against the full length sequence of the polynucleotide encoding a PtIP-83 polypeptide or against the full length sequence of a PtIP-83 polypeptide.

In some embodiments the nucleic acid encoding a PtIP-83 polypeptide is selected from SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 28, SEQ ID NO: 29, any one of SEQ ID NO: 172-235, any one of SEQ ID NO: 300-333, any one of SEQ ID NO:

368-397, any one of SEQ ID NO: 428-517, SEQ ID NO: 717, any one of SEQ ID NO: 718-727, and any one of SEQ ID NO: 738-753.

In some embodiments the nucleic acid encodes a PtIP-83 polypeptide having at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769. In some embodiments the sequence identity is calculated using ClustalW algorithm in the ALIGNX® module of the Vector NTI® Program Suite (Invitrogen Corporation, Carlsbad, Calif.) with all default parameters. In some embodiments the sequence identity is across the entire length of polypeptide calculated using ClustalW algorithm in the ALIGNX module of the Vector NTI Program Suite (Invitrogen Corporation, Carlsbad, Calif.) with all default parameters.

To determine the percent identity of two amino acid sequences or of two nucleic acid sequences, the sequences are aligned for optimal comparison purposes. The percent identity between the two sequences is a function of the number of identical positions shared by the sequences (i.e., percent identity=number of identical positions/total number of positions (e.g., overlapping positions)×100). In one embodiment, the two sequences are the same length. In another embodiment, the comparison is across the entirety of the reference sequence (e.g., across the entirety of SEQ ID NO: 1). The percent identity between two sequences can be determined using techniques similar to those described below, with or without allowing gaps. In calculating percent identity, typically exact matches are counted.

The determination of percent identity between two sequences can be accomplished using a mathematical algorithm. A non-limiting example of a mathematical algorithm utilized for the comparison of two sequences is the algorithm of Karlin and Altschul, (1990) *Proc. Natl. Acad. Sci. USA* 87:2264, modified as in Karlin and Altschul, (1993) *Proc. Natl. Acad. Sci. USA* 90:5873-5877. Such an algorithm is incorporated into the BLASTN and BLASTX programs of Altschul, et al., (1990) *J. Mol. Biol.* 215:403. BLAST nucleotide searches can be performed with the BLASTN program, score=100, wordlength=12, to obtain nucleic acid sequences homologous to pesticidal nucleic acid molecules of the embodiments. BLAST protein searches can be performed with the BLASTX program, score=50, wordlength=3, to obtain amino acid sequences homologous to pesticidal protein molecules of the embodiments. To obtain gapped alignments for comparison purposes, Gapped BLAST (in BLAST 2.0) can be utilized as described in Altschul, et al., (1997) *Nucleic Acids Res.* 25:3389. Alternatively, PSI-Blast can be used to perform an iterated search that detects distant relationships between molecules. See, Altschul, et al., (1997) supra. When utilizing BLAST, Gapped BLAST, and PSI-Blast programs, the default parameters of the respective programs (e.g., BLASTX and BLASTN) can be used. Alignment may also be performed manually by inspection.

Another non-limiting example of a mathematical algorithm utilized for the comparison of sequences is the ClustalW algorithm (Higgins, et al., (1994) *Nucleic Acids Res.* 22:4673-4680). ClustalW compares sequences and aligns the entirety of the amino acid or DNA sequence, and thus can provide data about the sequence conservation of the entire amino acid sequence. The ClustalW algorithm is used in several commercially available DNA/amino acid analysis software packages, such as the ALIGNX® module of the Vector NTI® Program Suite (Invitrogen Corporation, Carlsbad, Calif.). After alignment of amino acid sequences with ClustalW, the percent amino acid identity can be assessed. A non-limiting example of a software program useful for analysis of ClustalW alignments is GENEDOC™ GENEDOC™ (Karl Nicholas) allows assessment of amino acid (or DNA) similarity and identity between multiple proteins. Another non-limiting example of a mathematical algorithm utilized for the comparison of sequences is the algorithm of Myers and Miller, (1988) CABIOS 4:11-17. Such an algorithm is incorporated into the ALIGN program (version 2.0), which is part of the GCG Wisconsin Genetics Software Package, Version 10 (available from Accelrys, Inc., 9685 Scranton Rd., San Diego, Calif., USA). When utilizing the ALIGN program for comparing amino acid sequences, a PAM120 weight residue table, a gap length penalty of 12, and a gap penalty of 4 can be used.

Another non-limiting example of a mathematical algorithm utilized for the comparison of sequences is the algorithm of Needleman and Wunsch, (1970) *J. Mol. Biol.* 48(3):443-453, used GAP Version 10 software to determine sequence identity or similarity using the following default parameters: % identity and % similarity for a nucleic acid sequence using GAP Weight of 50 and Length Weight of 3, and the nwsgapdna.cmpii scoring matrix; % identity or % similarity for an amino acid sequence using GAP weight of 8 and length weight of 2, and the BLOSUM62 scoring program. Equivalent programs may also be used. "Equivalent program" is used herein to refer to any sequence comparison program that, for any two sequences in question, generates an alignment having identical nucleotide residue matches and an identical percent sequence identity when compared to the corresponding alignment generated by GAP Version 10.

The embodiments also encompass nucleic acid molecules encoding PtIP-83 polypeptide variants. "Variants" of the PtIP-83 polypeptide encoding nucleic acid sequences include those sequences that encode the PtIP-83 polypeptides disclosed herein but that differ conservatively because of the degeneracy of the genetic code as well as those that are sufficiently identical as discussed above. Naturally occurring allelic variants can be identified with the use of well-known molecular biology techniques, such as polymerase chain reaction (PCR) and hybridization techniques as outlined below. Variant nucleic acid sequences also include synthetically derived nucleic acid sequences that have been generated, for example, by using site-directed mutagenesis but which still encode the PtIP-83 polypeptides disclosed as discussed below.

The present disclosure provides isolated or recombinant polynucleotides that encode any of the PtIP-83 polypeptides disclosed herein. Those having ordinary skill in the art will readily appreciate that due to the degeneracy of the genetic code, a multitude of nucleotide sequences encoding PtIP-83 polypeptides of the present disclosure exist. Table 1 is a codon table that provides the synonymous codons for each amino acid. For example, the codons AGA, AGG, CGA, CGC, CGG, and CGU all encode the amino acid arginine. Thus, at every position in the nucleic acids of the disclosure where an arginine is specified by a codon, the codon can be altered to any of the corresponding codons described above without altering the encoded polypeptide. It is understood that U in an RNA sequence corresponds to T in a DNA sequence.

TABLE 1

| Alanine | Ala | A | GCA GCC GCG GC |
|---|---|---|---|
| Cystine | Cys | | UGC UGU |
| Aspartic acid | Asp | D | GAC GAU |
| Glutamic acid | Glu | E | GAA GAG |
| Phenylalanine | Phe | F | UUC UUU |
| Glycine | Gly | G | GGA GGC GGG GGU |
| Histidine | His | | CAC CAU |
| Isoleucine | II | I | AUA AUC AUU |
| Lysine | Lys | K | AAA AAG |
| Leucine | Leu | L | UUA UUG CUA CUC CUG C U |
| Methionine | Me | M | AUG |
| Asparagine | Asn | N | AAC AAU |
| Proline | Pro | P | CCA CCC CCG CCU |
| Glutamine | Gln | Q | CAA CAG |
| Arginine | Arg | R | AGA AGG CGA CGC CGG CGU |
| Serine | Ser | S | AGC AGU UCA UCC UCG UCC |
| Threonine | Thr | T | ACA ACC ACG ACU |
| Valine | Val | V | GUA GUC GUG GUU |
| Tryptophan | Trp | W | TGG |
| Tyrosine | Tyr | Y | UAC UAU |

The skilled artisan will further appreciate that changes can be introduced by mutation of the nucleic acid sequences thereby leading to changes in the amino acid sequence of the encoded PtIP-83 polypeptides, without altering the biological activity of the proteins. Thus, variant nucleic acid molecules can be created by introducing one or more nucleotide substitutions, additions and/or deletions into the corresponding nucleic acid sequence disclosed herein, such that one or more amino acid substitutions, additions or deletions are introduced into the encoded protein. Mutations can be introduced by standard techniques, such as site-directed mutagenesis and PCR-mediated mutagenesis. Such variant nucleic acid sequences are also encompassed by the present disclosure.

Alternatively, variant nucleic acid sequences can be made by introducing mutations randomly along all or part of the coding sequence, such as by saturation mutagenesis, and the resultant mutants can be screened for ability to confer pesticidal activity to identify mutants that retain activity. Following mutagenesis, the encoded protein can be expressed recombinantly, and the activity of the protein can be determined using standard assay techniques.

The polynucleotides of the disclosure and fragments thereof are optionally used as substrates for a variety of recombination and recursive recombination reactions, in addition to standard cloning methods as set forth in, e.g., Ausubel, Berger and Sambrook, i.e., to produce additional pesticidal polypeptide homologues and fragments thereof with desired properties. A variety of such reactions are known, including those developed by the inventors and their co-workers. Methods for producing a variant of any nucleic acid listed herein comprising recursively recombining such polynucleotide with a second (or more) polynucleotide, thus forming a library of variant polynucleotides are also embodiments of the disclosure, as are the libraries produced, the cells comprising the libraries and any recombinant polynucleotide produces by such methods. Additionally, such methods optionally comprise selecting a variant polynucleotide from such libraries based on pesticidal activity, as is wherein such recursive recombination is done in vitro or in vivo.

A variety of diversity generating protocols, including nucleic acid recursive recombination protocols are available and fully described in the art. The procedures can be used separately, and/or in combination to produce one or more variants of a nucleic acid or set of nucleic acids, as well as variants of encoded proteins. Individually and collectively, these procedures provide robust, widely applicable ways of generating diversified nucleic acids and sets of nucleic acids (including, e.g., nucleic acid libraries) useful, e.g., for the engineering or rapid evolution of nucleic acids, proteins, pathways, cells and/or organisms with new and/or improved characteristics.

While distinctions and classifications are made in the course of the ensuing discussion for clarity, it will be appreciated that the techniques are often not mutually exclusive. Indeed, the various methods can be used singly or in combination, in parallel or in series, to access diverse sequence variants.

The result of any of the diversity generating procedures described herein can be the generation of one or more nucleic acids, which can be selected or screened for nucleic acids with or which confer desirable properties or that encode proteins with or which confer desirable properties. Following diversification by one or more of the methods herein or otherwise available to one of skill, any nucleic acids that are produced can be selected for a desired activity or property, e.g. pesticidal activity or, such activity at a desired pH, etc. This can include identifying any activity that can be detected, for example, in an automated or automatable format, by any of the assays in the art, see, e.g., discussion of screening of insecticidal activity, infra. A variety of related (or even unrelated) properties can be evaluated, in serial or in parallel, at the discretion of the practitioner.

Descriptions of a variety of diversity generating procedures for generating modified nucleic acid sequences, e.g., those coding for polypeptides having pesticidal activity or fragments thereof, are found in the following publications and the references cited therein: Soong, et al., (2000) *Nat Genet* 25(4):436-439; Stemmer, et al., (1999) *Tumor Targeting* 4:1-4; Ness, et al., (1999) *Nat Biotechnol* 17:893-896; Chang, et al., (1999) *Nat Biotechnol* 17:793-797; Minshull and Stemmer, (1999) *Curr Opin Chem Biol* 3:284-290; Christians, et al., (1999) *Nat Biotechnol* 17:259-264; Crameri, et al., (1998) *Nature* 391:288-291; Crameri, et al., (1997) *Nat Biotechnol* 15:436-438; Zhang, et al., (1997) *PNAS USA* 94:4504-4509; Patten, et al., (1997) *Curr Opin Biotechnol* 8:724-733; Crameri, et al., (1996) *Nat Med* 2:100-103; Crameri, et al., (1996) *Nat Biotechnol* 14:315-319; Gates, et al., (1996) *J Mol Biol* 255:373-386; Stemmer, (1996) "Sexual PCR and Assembly PCR" In: *The Encyclopedia of Molecular Biology*. VCH Publishers, New York. pp. 447-457; Crameri and Stemmer, (1995) *BioTechniques*

18:194-195; Stemmer, et al., (1995) *Gene,* 164:49-53; Stemmer, (1995) *Science* 270: 1510; Stemmer, (1995) *Bio/Technology* 13:549-553; Stemmer, (1994) *Nature* 370:389-391 and Stemmer, (1994) *PNAS USA* 91:10747-10751.

Mutational methods of generating diversity include, for example, site-directed mutagenesis (Ling, et al., (1997) *Anal Biochem* 254(2):157-178; Dale, et al., (1996) *Methods Mol Biol* 57:369-374; Smith, (1985) *Ann Rev Genet* 19:423-462; Botstein and Shortle, (1985) *Science* 229:1193-1201; Carter, (1986) *Biochem J* 237:1-7 and Kunkel, (1987) "The efficiency of oligonucleotide directed mutagenesis" in *Nucleic Acids & Molecular Biology* (Eckstein and Lilley, eds., Springer Verlag, Berlin)); mutagenesis using uracil containing templates (Kunkel, (1985) *PNAS USA* 82:488-492; Kunkel, et al., (1987) *Methods Enzymol* 154:367-382 and Bass, et al., (1988) *Science* 242:240-245); oligonucleotide-directed mutagenesis (Zoller and Smith, (1983) *Methods Enzymol* 100:468-500; Zoller and Smith, (1987) *Methods Enzymol* 154:329-350 (1987); Zoller and Smith, (1982) *Nucleic Acids Res* 10:6487-6500), phosphorothioate-modified DNA mutagenesis (Taylor, et al., (1985) *Nucl Acids Res* 13:8749-8764; Taylor, et al., (1985) *Nucl Acids Res* 13:8765-8787 (1985); Nakamaye and Eckstein, (1986) *Nucl Acids Res* 14:9679-9698; Sayers, et al., (1988) *Nucl Acids Res* 16:791-802 and Sayers, et al., (1988) *Nucl Acids Res* 16:803-814); mutagenesis using gapped duplex DNA (Kramer, et al., (1984) *Nucl Acids Res* 12:9441-9456; Kramer and Fritz, (1987) *Methods Enzymol* 154:350-367; Kramer, et al., (1988) *Nucl Acids Res* 16:7207 and Fritz, et al., (1988) *Nucl Acids Res* 16:6987-6999).

Additional suitable methods include point mismatch repair (Kramer, et al., (1984) *Cell* 38:879-887), mutagenesis using repair-deficient host strains (Carter, et al., (1985) *Nucl Acids Res* 13:4431-4443 and Carter, (1987) *Methods in Enzymol* 154:382-403), deletion mutagenesis (Eghtedarzadeh and Henikoff, (1986) *Nucl Acids Res* 14:5115), restriction-selection and restriction-purification (Wells, et al., (1986) *Phil Trans R Soc Lond A* 317:415-423), mutagenesis by total gene synthesis (Nambiar, et al., (1984) *Science* 223:1299-1301; Sakamar and Khorana, (1988) *Nucl Acids Res* 14:6361-6372; Wells, et al., (1985) *Gene* 34:315-323 and Grundström, et al., (1985) *Nucl Acids Res* 13:3305-3316), double-strand break repair (Mandecki, (1986) *PNAS USA,* 83:7177-7181 and Arnold, (1993) *Curr Opin Biotech* 4:450-455). Additional details on many of the above methods can be found in *Methods Enzymol* Volume 154, which also describes useful controls for trouble-shooting problems with various mutagenesis methods.

Additional details regarding various diversity generating methods can be found in the following US patents, PCT Publications and applications and EPO publications: U.S. Pat. No. 5,723,323, U.S. Pat. No. 5,763,192, U.S. Pat. No. 5,814,476, U.S. Pat. No. 5,817,483, U.S. Pat. No. 5,824,514, U.S. Pat. No. 5,976,862, U.S. Pat. No. 5,605,793, U.S. Pat. No. 5,811,238, U.S. Pat. No. 5,830,721, U.S. Pat. No. 5,834,252, U.S. Pat. No. 5,837,458, WO 1995/22625, WO 1996/33207, WO 1997/20078, WO 1997/35966, WO 1999/41402, WO 1999/41383, WO 1999/41369, WO 1999/41368, EP 752008, EP 0932670, WO 1999/23107, WO 1999/21979, WO 1998/31837, WO 1998/27230, WO 1998/27230, WO 2000/00632, WO 2000/09679, WO 1998/42832, WO 1999/29902, WO 1998/41653, WO 1998/41622, WO 1998/42727, WO 2000/18906, WO 2000/04190, WO 2000/42561, WO 2000/42559, WO 2000/42560, WO 2001/23401 and PCT/US01/06775.

The nucleotide sequences of the embodiments can also be used to isolate corresponding sequences from ferns or other primitive plant, particularly a *Asplenium, Polypodium, Adiantum, Platycerium, Nephrolepis, Ophioglossum, Colysis, Bolbitis, Blechnum, Selaginella, Lycopodium,* and *Huperzia* species. In this manner, methods such as PCR, hybridization, and the like can be used to identify such sequences based on their sequence homology to the sequences set forth herein. Sequences that are selected based on their sequence identity to the entire sequences set forth herein or to fragments thereof are encompassed by the embodiments. Such sequences include sequences that are orthologs of the disclosed sequences. The term "orthologs" refers to genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species.

In a PCR approach, oligonucleotide primers can be designed for use in PCR reactions to amplify corresponding DNA sequences from cDNA or genomic DNA extracted from any organism of interest. Methods for designing PCR primers and PCR cloning are generally known in the art and are disclosed in Sambrook, et al., (1989) *Molecular Cloning: A Laboratory Manual* (2d ed., Cold Spring Harbor Laboratory Press, Plainview, N.Y.), hereinafter "Sambrook". See also, Innis, et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like. To identify potential PtIP-83 polypeptides from fern or moss collections, the fern or moss cell lysates can be screened with antibodies generated against a PtIP-83 polypeptides and/or PtIP-83 polypeptides using Western blotting and/or ELISA methods. This type of assays can be performed in a high throughput fashion. Positive samples can be further analyzed by various techniques such as antibody based protein purification and identification. Methods of generating antibodies are well known in the art as discussed infra.

Alternatively, mass spectrometry based protein identification method can be used to identify homologs of PtIP-83 polypeptides using protocols in the literatures (Scott Patterson, (1998), 10.22, 1-24, Current Protocol in Molecular Biology published by John Wiley & Son Inc). Specifically, LC-MS/MS based protein identification method is used to associate the MS data of given cell lysate or desired molecular weight enriched samples (excised from SDS-PAGE gel of relevant molecular weight bands to PtIP-83 polypeptides) with sequence information of PtIP-83 polypeptides SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769 and their homologs. Any match in peptide sequences indicates the potential of having the homologous proteins in the samples. Additional techniques (protein purification and molecular biology) can be used to isolate the protein and identify the sequences of the homologs.

In hybridization methods, all or part of the pesticidal nucleic acid sequence can be used to screen cDNA or genomic libraries. Methods for construction of such cDNA and genomic libraries are generally known in the art and are disclosed in Sambrook and Russell, (2001), supra. The so-called hybridization probes may be genomic DNA fragments, cDNA fragments, RNA fragments or other oligonucleotides and may be labeled with a detectable group such as 32P or any other detectable marker, such as other radioisotopes, a fluorescent compound, an enzyme or an enzyme co-factor. Probes for hybridization can be made by labeling synthetic oligonucleotides based on the known PtIP-83 polypeptide-encoding nucleic acid sequence disclosed herein. Degenerate primers designed on the basis of conserved nucleotides or amino acid residues in the nucleic acid sequence or encoded amino acid sequence can additionally be used. The probe typically comprises a region of nucleic acid sequence that hybridizes under stringent conditions to at least about 12, at least about 25, at least about 50, 75, 100, 125, 150, 175 or 200 consecutive nucleotides of nucleic acid sequence encoding a PtIP-83 polypeptide of the disclosure or a fragment or variant thereof. Methods for the preparation of probes for hybridization are generally known in the art and are disclosed in Sambrook and Russell, (2001), supra, herein incorporated by reference.

For example, an entire nucleic acid sequence, encoding a PtIP-83 polypeptide, disclosed herein or one or more portions thereof may be used as a probe capable of specifically hybridizing to corresponding nucleic acid sequences encoding PtIP-83 polypeptide-like sequences and messenger RNAs. To achieve specific hybridization under a variety of conditions, such probes include sequences that are unique and are preferably at least about 10 nucleotides in length or at least about 20 nucleotides in length. Such probes may be used to amplify corresponding pesticidal sequences from a chosen organism by PCR. This technique may be used to isolate additional coding sequences from a desired organism or as a diagnostic assay to determine the presence of coding sequences in an organism. Hybridization techniques include hybridization screening of plated DNA libraries (either plaques or colonies; see, for example, Sambrook, et al., (1989) Molecular Cloning: A Laboratory Manual (2d ed., Cold Spring Harbor Laboratory Press, Cold Spring Harbor, N.Y.). Hybridization of such sequences may be carried out under stringent conditions. "Stringent conditions" or "stringent hybridization conditions" is used herein to refer to conditions under which a probe will hybridize to its target sequence to a detectably greater degree than to other sequences (e.g., at least 2-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1000 nucleotides in length, preferably less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours.

Specificity is typically the function of post-hybridization washes, the critical factors being the ionic strength and temperature of the final wash solution. For DNA-DNA hybrids, the Tm can be approximated from the equation of Meinkoth and Wahl, (1984) *Anal. Biochem.* 138:267-284: Tm=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The Tm is the temperature (under defined ionic strength and pH) at which 50% of a complementary target sequence hybridizes to a perfectly matched probe. Tm is reduced by about 1° C. for each 1% of mismatching; thus, Tm, hybridization, and/or wash conditions can be adjusted to hybridize to sequences of the desired identity. For example, if sequences with 90% identity are sought, the Tm can be decreased 10° C. Generally, stringent conditions are selected to be about 5° C. lower than the thermal melting point (Tm) for the specific sequence and its complement at a defined ionic strength and pH. However, severely stringent conditions can utilize a hybridization and/or wash at 1, 2, 3 or 4° C. lower than the thermal melting point (Tm); moderately stringent conditions can utilize a hybridization and/or wash at 6, 7, 8, 9 or 10° C. lower than the thermal melting point (Tm); low stringency conditions can utilize a hybridization and/or wash at 11, 12, 13, 14, 15 or 20° C. lower than the thermal melting point (Tm). Using the equation, hybridization and wash compositions, and desired Tm, those of ordinary skill will understand that variations in the stringency of hybridization and/or wash solutions are inherently described. If the desired degree of mismatching results in a Tm of less than 45° C. (aqueous solution) or 32° C. (formamide solution), it is preferred to increase the SSC concentration so that a higher temperature can be used. An extensive guide to the hybridization of nucleic acids is found in Tijssen, (1993) Laboratory Techniques in Biochemistry and Molecular Biology-Hybridization with Nucleic Acid Probes, Part I, Chapter 2 (Elsevier, N.Y.); and Ausubel, et al., eds. (1995) Current Protocols in Molecular Biology, Chapter 2 (Greene Publishing and Wiley-Interscience, New York). See, Sambrook, et al., (1989) Molecular Cloning: A Laboratory Manual (2d ed., Cold Spring Harbor Laboratory Press, Cold Spring Harbor, N.Y.).

In some embodiments polynucleotides are provided encoding a PtIP-83 polypeptide comprising an amino acid sequence having at least 80%, at least 85%, at least 90%, at least 95%, at least 96%, at least 97%, at least 98% or at least 99% sequence identity to any one of SEQ ID NO: 786-888.

In some embodiments polynucleotides are provided encoding a PtIP-83 polypeptide comprising the amino acid sequence of any one of SEQ ID NO: 786-888.

In some embodiments the polynucleotide encoding the PtIP-83 polypeptide comprising the amino acid sequence of any one of SEQ ID NO: 786-888 is a non-genomic sequence.

In some embodiments the polynucleotide encoding the PtIP-83 polypeptide comprising the amino acid sequence of any one of SEQ ID NO: 786-888 is a cDNA.

Proteins and Variants and Fragments Thereof

PtIP-83 polypeptides are also encompassed by the disclosure. "*Pteridophyta* Insecticidal Protein-83" "PtIP-83 polypeptide", and "PtIP-83 protein" as used herein interchangeably refers to a polypeptide having insecticidal activity including but not limited to insecticidal activity against one or more insect pests of the Lepidoptera and/or Coleoptera orders, and is sufficiently homologous to the protein of SEQ ID NO: 1. A variety of PtIP-83 polypeptides are contemplated. Sources of PtIP-83 polypeptides or related proteins are fern species selected from but not limited to *Polypodium punctatum, Lygodium flexuosum, Microsorum musifolium, Adiantum peruvianum, Adiantum trapeziforme* and *Adiantum pedatum*.

"Sufficiently homologous" is used herein to refer to an amino acid sequence that has at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence homology compared to a reference sequence using one of the alignment programs described herein using standard parameters. In some embodiments the sequence homology is against the full length sequence of a PtIP-83 polypeptide. In some embodiments the PtIP-83 polypeptide has at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 1. One of skill in the art will recognize that these values can be appropriately adjusted to determine corresponding homology of proteins taking into account amino acid similarity and the like. In some embodiments the sequence identity is calculated using ClustalW algorithm in the ALIGNX® module of the Vector NTI® Program Suite (Invitrogen Corporation, Carlsbad, Calif.) with all default parameters. In some embodiments the sequence identity is across the entire length of polypeptide calculated using ClustalW algorithm in the ALIGNX® module of the Vector NTI® Program Suite (Invitrogen Corporation, Carlsbad, Calif.) with all default parameters.

As used herein, the terms "protein," "peptide molecule," or "polypeptide" includes any molecule that comprises five or more amino acids. It is well known in the art that protein, peptide or polypeptide molecules may undergo modification, including post-translational modifications, such as, but not limited to, disulfide bond formation, glycosylation, phosphorylation or oligomerization. Thus, as used herein, the terms "protein," "peptide molecule" or "polypeptide" includes any protein that is modified by any biological or non-biological process. The terms "amino acid" and "amino acids" refer to all naturally occurring L-amino acids.

A "recombinant protein" or "recombinant polypeptide" is used herein to refer to a protein that is no longer in its natural environment, for example in vitro or in a recombinant bacterial or plant host cell. A "purified protein" or "purified polypeptide" is used herein to refer to a protein that is substantially free of cellular material. A PtIP-83 polypeptide that is substantially free of cellular material includes preparations of protein having less than about 30%, 20%, 10% or 5% (by dry weight) of non-pesticidal protein (also referred to herein as a "contaminating protein").

"Fragments" or "biologically active portions" include polypeptide fragments comprising amino acid sequences sufficiently identical to a PtIP-83 polypeptide and that exhibit insecticidal activity. "Fragments" or "biologically active portions" of PtIP-83 polypeptides includes fragments comprising amino acid sequences sufficiently identical to the amino acid sequence set forth in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769, wherein the PtIP-83 polypeptide has insecticidal activity. Such biologically active portions can be prepared by recombinant techniques and evaluated for insecticidal activity. In some embodiments, the PtIP-83 polypeptide fragment is an N-terminal and/or a C-terminal truncation of at least about 1, 2, 3, 4, 5, 6, 7, 8, 9, 10, 11, 12, 13, 14, 15, 16, 17, 18, 19, 20, 25, 26, 27, 28, 29, 30, 31, 32, 33, 34 or more amino acids from the N-terminus and/or C-terminus relative to SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769, e.g., by proteolysis, by insertion of a start codon, by deletion of the codons encoding the deleted amino acids and concomitant insertion of a start codon, and/or insertion of a stop codon.

In some embodiments, the PtP-83 polypeptide fragments encompassed herein result from the removal of the N-terminal 1, 2, 3, 4, 5, 6, 7, 8, 9 or 10 or more amino acids relative to SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, SEQ ID NO: 769 or variants thereof, e.g., by proteolysis or by insertion of a start codon, by deletion of the codons encoding the deleted amino acids and concomitant insertion of a start codon.

"Variants" as used herein refers to proteins or polypeptides having an amino acid sequence that is at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98% or 99% identical to the parental amino acid sequence.

In some embodiments a PtIP-83 polypeptide comprises an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769, wherein the PtIP-83 polypeptide has insecticidal activity.

In some embodiments a PtIP-83 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98% or 99% identity across the entire length of the amino acid sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769.

In some embodiments a PtIP-83 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98% or 99% identity across the entire length of the amino acid sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769, and has at least one amino acid substitution, deletion, insertion, and/or addition at the N-terminus or C-terminus compared to the native sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769.

In some embodiments a PtIP-83 polypeptide comprises an amino acid sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70 or more amino acid substitutions compared to the native amino acid at the corresponding position of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769.

In some embodiments the sequence identity is across the entire length of the polypeptide calculated using ClustalW algorithm in the ALIGNX® module of the Vector NTI® Program Suite (Invitrogen Corporation, Carlsbad, Calif.) with all default parameters.

In some embodiments a PtIP-83 polypeptide comprises an amino acid sequence having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59 or 60 amino acid substitutions, in any combination, compared to the native amino acid at the corresponding position of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769.

In some embodiments a PtIP-83 polypeptide comprises an amino acid sequence having 1, 2, 3, 4, 5, 6, 7, 8, 9, 10 11, 12, 13, 14, 15, 16, 17, 18, 19, 20, 21, 22, 23, 24, 25, 26, 27, 28 or 29 amino acid substitutions, in any combination, compared to the native amino acid at the corresponding position of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769.

In some embodiments the PtIP-83 polypeptide comprises an amino acid sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769.

In some embodiments the PtIP-83 polypeptide comprises a non-naturally occurring amino acid sequence. As used herein the term "non-naturally occurring amino acid sequence" means an amino acid sequence not found in nature.

In some embodiments the PtIP-83 polypeptide is not the polypeptide of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO:

760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769.

In some embodiments the PtIP-83 polypeptide is a variant of the polypeptide of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769, wherein the PtIP-83 polypeptide variant has at least one amino acid substitution, deletion, insertion, and/or addition at the N-terminus or C-terminus compared to SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769.

In some embodiments PtIP-83 polypeptide comprising an amino acid sequence of any one of SEQ ID NO: 236-299, SEQ ID NO: 334-367, SEQ ID NO: 398-427, SEQ ID NO: 518-607, SEQ ID NO: 640-645, and SEQ ID NO: 728-737.

In some embodiments the PtIP-83 polypeptide is a variant of SEQ ID NO: 1, wherein the amino acid at position 53 is Val, Ala, Cys or Thr; the amino acid at position 54 is Lys, Ala, Cys, Asp, Glu, Gly, His, Ile, Leu, Met, Asn, Gln, Arg, Ser or Thr; the amino acid at position 55 is Arg, Ala, Asp, Glu, Phe, Gly, His, Lys, Leu, Met, Asn, Gln, Ser, Thr, Val, Trp or Tyr; the amino acid at position 56 is Leu, Glu, Phe, Ile, Met, Thr or Val; the amino acid at position 57 is Tyr, Cys, Ile, Leu, Met, Thr or Val; the amino acid at position 58 is Val, Cys, Ile or Leu; the amino acid at position 59 is Phe, Leu, Met, Val or Tyr; the amino acid at position 60 is Ala, Cys, Gly, Ser, Thr or Val; the amino acid at position 61 is Asp, Glu, His or Ser; the amino acid at position 62 is Val, Ala, Cys, Ile, Leu or Thr; the amino acid at position 63 is Val, Ala, Cys, Ile, Leu, Met or Thr; the amino acid at position 64 is Gln, Ala, Cys, Phe, Gly, His, Ile, Leu, Met, Asn, Gln, Arg, Ser, Thr, Val, Trp or Tyr; the amino acid at position 65 is Leu, Ala, Cys, Phe, His, Ile, Met, Asn, Gln, Thr, Val or Trp; the amino acid at position 66 is Pro, Asp, Gly, Met, Gln or Arg; the amino acid at position 363 is Gln, Ala, Cys, Glu, Phe, Gly, His, Lys, Leu, Asn, Arg, Ser, Thr, Val or Trp; the amino acid at position 364 is Ile, Ala, Cys, Glu, Phe, His, Lys, Leu, Met, Asn, Gln, Ser, Thr, Val, Trp or Tyr; the amino acid at position 365 is Leu, Ala, Glu, Phe, Gly, His, Ile, Lys, Met, Asn, Arg, Val, Trp or Tyr; the amino acid at position 366 is Gly, Ala, Cys, Phe, His, Ile, Lys, Leu, Met, Asn, Ser, Thr or Val; the amino acid at position 367 is Ser, Ala, Cys, Asp, Glu, Phe, Gly, His, Ile, Leu, Met, Asn, Pro, Gln, Arg, Thr, Val or Trp; the amino acid at position 368 is Tyr, Ala, Cys, Asp, Glu, Phe, Gly, His, Ile, Lys, Leu, Met, Asn, Pro, Gln, Arg, Ser, Thr, Val or Trp; the amino acid at position 369 is Leu, Ala, Cys, Asp, Phe, Gly, Ile, Met, Thr or Val; the amino acid at position 370 is Leu, Ala, Cys, Asp, Glu, Phe, Gly, His, Ile, Lys, Met, Gln, Arg, Ser, Thr, Val, Trp or Tyr; the amino acid at position 371 is Gln, Ala, Cys, Asp, Glu, Phe, Gly, Ile, Lys, Leu, Asn, Arg, Ser, Thr, Val or Trp; the amino acid at position 372 is Gln, Ala, Cys, Asp, Phe, Gly, His, Ile, Leu, Asn, Arg, Ser, Val or Tyr; the amino acid at position 373 is Asn, Ala, Cys, Asp, Phe, Gly, His, Ile, Lys, Gln, Ser, Thr, Val or Trp; the amino acid at position 556 is Trp, Phe, Thr or Tyr; the amino acid at position 557 is Arg, Cys, Asp, Gly, His, Ile, Lys, Leu, Met, Asn, Pro, Gln, Ser, Thr, Val, Trp or Tyr; the amino acid at position 558 is Ala, Cys, Asp, Phe, Gly, His, Ile, Lys, Leu, Asn, Pro, Gln, Arg, Ser, Val, Trp or Tyr; the amino acid at position 559 is Lys, Ala, Cys, Phe, Gly, His, Ile, Leu, Asn, Gln, Arg, Ser, Thr, Val or Tyr; the amino acid at position 560 is Cys, Ala, Phe, Gly, Ile, Met, Asn, Arg, Ser, Thr or Val; the amino acid at position 561 is Lys, Ala, Cys, Asp, Glu, Phe, Gly, His, Ile, Leu, Met, Asn, Arg, Ser, Thr, Val or Tyr; the amino acid at position 562 is Asn, Cys, Asp, Glu, Gly, His, Leu, Met, Arg, Ser, Thr, Val or Tyr; the amino acid at position 563 is Val, Ala, Cys, Asp, Phe, His, Ile, Leu, Met, Asn, Gln, Thr or Trp; the amino acid at position 564 is Ala, Cys, Gly, Met, Gln, Ser, Thr, Val, Trp or Tyr; the amino acid at position 646 is Leu, Ala, Cys, Gly, Ile, Met, Asn, Gln, Ser, Thr or Val; the amino acid at position 647 is Leu, Asp, Gly, Met, Asn, Gln or Thr; the amino acid at position 648 is Met, Ala, Cys, Asp, Glu, Phe, Gly, His, Lys, Leu, Asn, Pro, Gln, Arg, Ser, Thr, Val, Trp or Tyr; the amino acid at position 649 is Pro, Ala, Cys, Asp, Glu, Phe, Gly, His, Lys, Met, Asn, Gln, Arg, Ser, Thr, Trp or Tyr; the amino acid at position 650 is Thr, Ala, Cys, Asp, Phe, Gly, His, Ile, Lys, Leu, Met, Pro, Gln, Arg, Ser, Val or Tyr; the amino acid at position 651 is Glu, Ala, Cys, Asp, Gly, His, Ile, Leu, Met, Asn, Pro, Gln, Arg, Ser, Thr, Val or Tyr; the amino acid at position 652 is Leu, Cys, Phe, Ile, Lys, Met, Pro, Arg, Ser, Thr or Val; the amino acid at position 653 is Thr, Cys, Asp, Glu, Phe, Gly, His, Ile, Lys, Leu, Pro, Arg, Ser, Val or Trp; the amino acid at position 654 is Thr, Ala, Cys, Phe, Ile, Lys, Leu, Met, Pro, Arg, Ser, Val, Trp or Tyr; the amino acid at position 655 is Trp, Phe or Tyr; the amino acid at position 771 is Arg, Ala, Asp, Glu, Phe, Gly, His, Ile, Lys, Leu, Asn, Ser, Thr, Val, Trp or Tyr; the amino acid at position 772 is Arg, Ala, Cys, Asp, Glu, Phe, Gly, His, Ile, Lys, Leu, Met, Pro, Gln, Ser, Thr, Val, Trp or Tyr; the amino acid at position 773 is Asp, Ala, Glu, Phe, Gly, His, Ile, Lys, Leu, Met, Asn, Gln, Arg, Ser, Thr, Val, Trp or Tyr; the amino acid at position 774 is Gln, Ala, Asp, Gly, His, Ile, Lys, Leu, Met, Asn, Pro, Arg, Ser, Thr, Val, Trp or Tyr; the amino acid at position 775 is Val, Ala, Cys, Asp, Glu, Gly, His, Ile, Asn, Pro, Gln, Arg, Ser, Thr or Tyr; the amino acid at position 776 is Leu, Ala, Cys, Asp, Glu, Phe, Gly, His, Ile, Lys, Asn, Pro, Gln, Arg, Ser, Thr, Val or Tyr; the amino acid at position 777 is Pro, Ala, Cys, Asp, Glu, Phe, Gly, His, Lys, Leu, Met, Asn, Gln, Ser, Thr, Val, Trp or Tyr; the amino acid at position 778 is Phe, Ala, His, Ile, Leu, Met, Asn, Gln, Ser, Val, Trp or Tyr; the amino acid at position 779 is Gln, Ala, Cys, Asp, Glu, Gly, His, Lys, Leu, Asn, Pro, Arg, Ser, Thr or Val; the amino acid at position 780 is Ala, Cys, Asn, Pro, Gln or Ser; the amino acid at position 781 is Ala, Cys, Asp, Glu, Phe, Gly, His, Ile, Asn, Gln, Arg, Ser, Thr, Val, Trp or Tyr; the amino acid at position 782 is Ala, Cys, Asp, Glu, Phe, Gly, His, Ile, Lys, Met, Pro, Gln, Arg, Ser, Thr, Val, Trp or Tyr; the amino acid at position 783 is Pro, Ala, Cys, Asp, Glu, Gly, His, Asn, Gln, Arg, Ser, Thr or Val; the amino acid at position 784 is Leu, Ala, Glu, Phe, His, Ile, Lys, Met, Asn, Pro, Gln, Ser, Thr, Val or Trp; the amino acid at position 785 is Asn, Ala, Cys, Glu, Phe, Gly, His, Ile, Lys, Leu, Met, Gln, Arg, Ser, Thr, Val, Trp or Tyr; and the amino acid at position 786 is Tyr, Phe, Ile, Leu or Trp.

In some embodiments the PtIP-83 polypeptide is a variant of SEQ ID NO: 1, wherein the amino acid at position 1 is Met or deleted; the amino acid at position 2 is Ala or deleted; the amino acid at position 3 is Leu, Val or deleted; the amino acid at position 4 is Val, Met or Leu; the amino acid at position 7 is Gly or Ser; the amino acid at position 8 is Lys or Thr; the amino acid at position 10 is Phe or Tyr; the amino acid at position 11 is Glu or Arg; the amino acid at position 18 is Met or Ile; the amino acid at position 19 is Gly, Pro or Ala; the amino acid at position 20 is Val or deleted; the amino acid at position 21 is Leu or Val; the amino acid at position 23 is Arg or Gln; the amino acid at position 37 is Val or Leu; the amino acid at position 38 is Arg or Asn; the amino acid at position 40 is Ala or Ser; the amino acid at position 43 is Asn or Asp; the amino acid at position 45 is Gly or Ala; the amino acid at position 46 is Gln or Glu; the amino acid at position 48 is Glu, Pro or Val; the amino acid at position 51 is Glu or Gly; the amino acid at position 52 is Lys, Arg or Thr; the amino acid at position 56 is Leu or Val; the amino acid at position 59 is Phe or Leu; the amino acid at position 66 is Pro or Ala; the amino acid at position 67 is Val, Pro or Thr; the amino acid at position 68 is Val, Arg, Phe or Gly; the amino acid at position 69 is Glu, Ala or Lys; the amino acid at position 70 is Trp, Thr, His, Tyr or Arg; the amino acid at position 71 is Arg, Pro or deleted; the amino acid at position 72 is Trp, Asp, Leu or deleted; the amino acid at position 73 is Pro, Gln, Asn, His or deleted; the amino acid at position 74 is Pro, Met or Thr; the amino acid at position 75 is Gln, His or Arg; the amino acid at position 76 is Ile, Met or Leu; the amino acid at position 84 is Ile or Val; the amino acid at position 91 is Trp or Phe; the amino acid at position 93 is Thr or Ile; the amino acid at position 94 is Asp or Gly; the amino acid at position 96 is Arg or Ser; the amino acid at position 97 is Gln, Phe or Arg; the amino acid at position 98 is Ser or deleted; the amino acid at position 99 is Asp or Ala; the amino acid at position 100 is Thr or Ala; the amino acid at position 101 is Glu, Thr or Trp the amino acid at position 103 is His, Arg, Glu or Gln; the amino acid at position 105 is Thr or Pro; the amino acid at position 108 is Lys, Gln or Glu; the amino acid at position 109 is Leu or Val; the amino acid at position 111 is Ala or Thr; the amino acid at position 112 is Ile, Arg, Thr or deleted; the amino acid at position 113 is Gln, Ala, Gly or deleted; the amino acid at position 114 is Arg, Glu or Ile; the amino acid at position 115 is Glu or Gln; the amino acid at position 116 is Glu, Asn, Gln or Arg; the amino acid at position 117 is Asn, Val, Tyr or Phe; the amino acid at position 118 is Arg or Lys; the amino acid at position 119 is Trp or Ser; the amino acid at position 122 is Thr, Lys or Ala; the amino acid at position 124 is Ala or Thr; the amino acid at position 126 is Gly or Asp; the amino acid at position 127 is Met or Ala; the amino acid at position 128 is Asn or Lys; the amino acid at position 131 is Val, Ile or Thr; the amino acid at position 133 is Ile or Val; the amino acid at position 134 is His or Tyr; the amino acid at position 135 is Ala or Gly; the amino acid at position 137 is Glu or Lys; the amino acid at position 139 is Gln or Glu; the amino acid at position 140 is Val, Arg or Leu; the amino acid at position 141 is Gly or Ser; the amino acid at position 142 is Val or Pro; the amino acid at position 144 is Thr, Leu, Phe or Tyr; the amino acid at position 145 is Met, Pro or Asn; the amino acid at position 146 is Ser, Gly or Asn; the amino acid at position 147 is Trp or Asn; the amino acid at position 148 is Ser, Ala or Pro; the amino acid at position 149 is Ser or deleted; the amino acid at position 150 is Val, Ile or Tyr; the amino acid at position 152 is Arg, Ala, Val or Gly; the amino acid at position 154 is Ser, Trp or Glu; the amino acid at position 156 is Leu, Asp or Gln; the amino acid at position 158 is Ser or Cys; the amino acid at position 159 is Val, Thr or Ile; the amino acid at position 162 is Ser or Ala; the amino acid at position 163 is Gly or deleted; the amino acid at position 164 is Phe or deleted; the amino acid at position 165 is Arg or Ala; the amino acid at position 166 is Ala, Arg, Met or Phe; the amino acid at position 167 is Val or His; the amino acid at position 168 is Ser or Asn; the amino acid at position 169 is Val, His or Thr; the amino acid at position 170 is Phe or Val; the amino acid at position 171 is Glu, Asn or Asp; the amino acid at position 172 is Val, Ala, Arg or Glu; the amino acid at position 175 is Ser, Arg or Trp; the amino acid at position 176 is Val or Ile; the amino acid at position 177 is Arg or Ile; the amino acid at position 179 is Thr, Ile, Val or Ser; the amino acid at position 180 is Leu, Phe or Thr; the amino acid at position 181 is Gly, Thr, Gln or Ser; the amino acid at position 182 is Ala, Leu, Phe or Ile; the amino acid at position 183 is Thr or Gly; the amino acid at position 184 is Leu, Thr, Ser or Arg; the amino acid at position 185 is Arg, Gly, Asp or Ala; the amino acid at position 186 is Pro, Val or Gln; the amino acid at position 187 is Asp, Thr or Ser; the amino acid at position 188 is His, Gly or Ala; the amino acid at position 189 is Ala, Arg, Pro or deleted; the amino acid at position 190 is Leu, Asn or deleted; the amino acid at position 191 is Tyr or deleted; the amino acid at position 192 is Ser, Ile, Val or Asn; the amino acid at position 193 is Thr or Asp; the amino acid at position 194 is Thr or Ser; the amino acid at position 195 is Met or Thr; the amino acid at position 196 is Gln, His, Leu or Ser; the amino acid at position 197 is Ala, Gly or Leu; the amino acid at position 198 is Thr, Glu or Ala; the amino acid at position 199 is Pro or Arg; the amino acid at position 200 is Asn, Ser, Thr or Gly; the amino acid at position 201 is Ala, Leu, Glu or Trp; the amino acid at position 202 is Ser, Asp, Phe or Leu; the amino acid at position 203 is His, Pro, Gly or Ser; the amino acid at position 204 is Ile, Trp, His or Gly; the amino acid at position 205 is Ser, Asn or Ile; the amino acid at position 206 is Ala, Gly, Asp, Tyr or Arg; the amino acid at position 207 is Phe, Val or Leu; the amino acid at position 208 is Asn, Ser, Pro or Leu; the amino acid at position 210 is Arg, Asp, Glu or Tyr; the amino acid at position 211 is Ile, Ser or Thr; the amino acid at position 212 is Val, Ala or Asp; the amino acid at position 214 is Pro or Arg; the amino acid at position 215 is Ser or Thr; the amino acid at position 217 is Tyr or Phe; the amino acid at position 218 is Arg or Ser; the amino acid at position 219 is Val or Ala; the amino acid at position 220 is Cys, Leu or Ser; the amino acid at position 221 is Pro or His; the amino acid at position 222 is Leu, Arg or Ser; the amino acid at position 224 is Asn or Ser; the amino acid at position 225 is Asp, Arg or Thr; the amino acid at position 226 is Thr or Asn; the amino acid at position 227 is Asp, Leu or deleted; the amino acid at position 228 is Thr or deleted; the amino acid at position 229 is Tyr or deleted; the amino acid at position 230 is Leu or deleted; the amino acid at position 231 is Gly or deleted; the amino acid at position 232 is Ile or deleted; the amino acid at position 233 is Pro or deleted; the amino acid at position 234 is Ala, Pro or deleted; the amino acid at position 235 is Asp, Ile or Val; the amino acid at position 236 is Val, Ser or Glu; the amino acid at position 237 is Ala, Phe or Tyr; the amino acid at position 238 is Ala or Thr; the amino acid at position 239 is Val, Ser or Gly; the amino acid at position 240 is Leu or Ile; the amino acid at position 243 is Asp or Glu; the amino acid at position 249 is Asn or Ser; the amino acid at position 252 is Leu or Met; the amino acid at position 257 is Thr or Ser; the amino acid at position 259 is His or Leu; the amino acid at position 266 is Ala or Val; the amino acid at position 267 is Cys or Gly; the amino acid at position 268 is His, Arg or Tyr; the amino acid at position 272 is Asp or Glu; the amino acid at position 273 is Val, Met, Ile or Leu; the amino acid at position 274 is Val or Met; the amino acid at position 278 is Gly or Ala; the amino acid at position 279 is Glu or Val; the amino acid at position 281 is Leu or Ala; the amino acid at position 282 is Asn, Leu or Ile; the amino acid at position 285 is Asn or Ser; the amino acid at position 286 is Lys, Asp or Glu; the amino acid at position 287 is Leu or Val; the amino acid at position 290 is Pro, Gln or Arg; the amino acid at position 291 is Leu or Val; the amino acid at position 292 is Lys or Val; the amino acid at position 293 is Glu or Gln; the amino acid at position 294 is Ser, Asn or Lys; the amino acid at position 295 is Thr or Ser; the amino acid at position 296 is Gln or His; the amino acid at position 297 is Leu or Met; the amino acid at position 300 is Ser or Thr; the amino acid at position 301 is Glu or Ala; the amino acid at position 302 is Ser, Pro or Ala; the amino acid at position 304 is Lys or Asn; the amino acid at position 313 is Val or Ile; the amino acid at position 314 is His, Glu or Gln; the amino acid at position 315 is Ala, Cys or Ser; the amino acid at position 316 is Ala or Val; the amino acid at position 317 is Met or Ile; the amino acid at position 319 is Met or Ile; the amino acid at position 320 is Val or Gly; the amino acid at position 321 is Arg or Pro; the amino acid at position 322 is Ile or Phe; the amino acid at position 323 is Gly or Val; the amino acid at position 324 is Leu or Ser; the amino acid at position 336 is Ser or Asn; the amino acid at position 339 is Asn, Lys or Arg; the amino acid at position 350 is Arg or Gln; the amino acid at position 351 is Glu or Asp; the amino acid at position 353 is Lys or Arg; the amino acid at position 354 is Gln or Arg; the amino acid at position 355 is Phe or Leu; the amino acid at position 356 is Lys or Arg; the amino acid at position 360 is Ile, Val or Ala; the amino acid at position 365 is Leu or Phe; the amino acid at position 371 is or Glu; the amino acid at position 372 is or Lys; the amino acid at position 374 is Arg or Lys; the amino acid at position 376 is Phe or Leu; the amino acid at position 378 is Glu or Asp; the amino acid at position 381 is Leu or Val; the amino acid at position 388 is Ala or Ser; the amino acid at position 395 is Arg or Lys; the amino acid at position 396 is Glu, Gln or Gly; the amino acid at position 399 is Asp or Asn; the amino acid at position 400 is Asn, Thr or Asp; the amino acid at position 401 is Thr or Ala; the amino acid at position 402 is Phe, Ile or Leu; the amino acid at position 406 is Asp or Glu; the amino acid at position 408 is Leu or Met; the amino acid at position 410 is Gly or Leu; the amino acid at position 414 is Ala or Glu; the amino acid at position 416 is Ser, Asn or Asp; the amino acid at position 417 is Ser, Arg or Gly; the amino acid at position 423 is Lys or Gln; the amino acid at position 431 is Arg or Lys; the amino acid at position 432 is Gln or Glu; the amino acid at position 436 is Arg or Glu; the amino acid at position 440 is Asn or Arg; the amino acid at position 442 is Leu or Val; the amino acid at position 447 is Ser, Lys or Arg; the amino acid at position 448 is Ala or Ser; the amino acid at position 451 is Gln or Met; the amino acid at position 453 is Gly or Ala; the amino acid at position 455 is Ala or Val; the amino acid at position 457 is Leu or Val; the amino acid at position 467 is Val or Ala; the amino acid at position 471 is Gly or Ala; the amino acid at position 475 is Ser or Asn; the amino acid at position 483 is Gly or Ala; the amino acid at position 493 is Gln or Gly; the amino acid at position 504 is Val or Ile; the amino acid at position 506 is Asp or His; the amino acid at position 509 is Asp or Asn; the amino acid at position 510 is Ser or Ala; the amino acid at position 512 is Glu or Asp; the amino acid at position 515 is Gly or Ser; the amino acid at position 516 is Gln or His; the amino acid at position 517 is Ile or Leu; the amino acid at position 519 is Asp, Gly or Gln; the amino acid at position 522 is Val, Glu, Pro or Val; the amino acid at position 525 is Glu or Asp; the amino acid at position 526 is Leu or Met; the amino acid at position 539 is Val or Ile; the amino acid at position 555 is Val or Ala; the amino acid at position 557 is Arg or Lys; the amino acid at position 563 is Val or Met; the amino acid at position 571 is Ser or Cys; the amino acid at position 575 is Val or Glu; the amino acid at position 577 is Met or Ile; the amino acid at position 579 is Glu or Gln; the amino acid at position 583 is Asp or Glu; the amino acid at position 589 is Met or Leu; the amino acid at position 590 is Met or Leu; the amino acid at position 593 is Met or Ile; the amino acid at position 595 is Arg or Gln; the amino acid at position 596 is Ser or Thr; the amino acid at position 597 is Gln or His; the amino acid at position 607 is Ala or Val; the amino acid at position 608 is Asp or Asn; the amino acid at position 612 is Tyr, His or Phe; the amino acid at position 617 is Thr or Ile; the amino acid at position 618 is Gln or His; the amino acid at position 625 is Arg or Ser; the amino acid at position 626 is Met or Ile; the amino acid at position 628 is Leu or Ile; the amino acid at position 633 is Ile or Met; the amino acid at position 634 is Leu or Met; the amino acid at position 642 is Arg or Met; the amino acid at position 648 is Met or Thr; the amino acid at position 651 is Glu or Gln; the amino acid at position 654 is Thr, Val or Ala; the amino acid at position 658 is Gly or Arg; the amino acid at position 663 is Gly or Ala; the amino acid at position 664 is Asp or Asn; the amino acid at position 668 is Ala or Thr; the amino acid at position 669 is Gln or His; the amino acid at position 671 is Asn or Ser the amino acid at position 675 is Ile, Val or Ser; the amino acid at position 678 is Met, Ile, Ala or Thr; the amino acid at position 682 is Pro or Gln; the amino acid at position 683 is Ser or Pro; the amino acid at position 685 is Asp or Asn; the amino acid at position 694 is Asp or Gly; the amino acid at position 697 is Asn or Ser; the amino acid at position 704 is Glu or Gly; the amino acid at position 714 is Ala or Gly; the amino acid at position 721 is Ser or Phe; the amino acid at position 722 is Ser or Asn; the amino acid at position 724 is Ser or Thr; the amino acid at position 734 is His or Gln; the amino acid at position 736 is Val or Ala; the amino acid at position 737 is Lys or Gln; the amino acid at position 739 is Ala or Ser; the amino acid at position 740 is Ser or Met; the amino acid at position 741 is Gly or Asn; the amino acid at position 742 is Ile or Gly; the amino acid at position 743 is Gly or deleted; the amino acid at position 745 is Gly or Asp; the amino acid at position 751 is Thr, Ser or Ala; the amino acid at position 753 is Gln or Arg; the amino acid at position 754 is Thr or Ser; the amino acid at position 756 is Thr or Ile; the amino acid at position 757 is Val or Ile; the amino acid at position 766 is Ile or Val; the amino acid at position 773 is Asp or Glu; the amino acid at position 774 is Gln or Glu; the amino acid at position 776 is Leu or Met; the amino acid at position 777 is Pro or Thr; the amino acid at position 782 is Ala, Asp or Val; the amino acid at position 786 is Tyr or Phe; the amino acid at position 787 is His or Gln; the amino acid at position 788 is Tyr or Met; the amino acid at position 789 is Ala or Arg; the amino acid at position 790 is Tyr or Thr; the amino acid at position 791 is Arg or Ala; the amino acid at position 792 is Leu or Ser; the amino acid at position 796 is Asp or Glu; the amino acid at position 797 is Ser, Thr or Ala the amino acid at position 802 is Glu or Gln; the amino acid at position 806 is Gln, Asp, Glu or His; the amino acid at position 810 is Lys or Thr; the amino acid at position 819 is Arg or His; the amino acid at position 829 is Lys, Ser, Ala or Pro; the amino acid at position 832 is Ala, Lys or Glu; the amino acid at position 833 is Gly or Glu; the amino acid at position 842 is Leu or Pro; the amino acid at position 847 is Gln or Glu; the amino acid at position 848 is Ile or Val; the amino acid at position 849 is Val or Ala; the amino acid at position 855 is Thr or Met; the amino acid at position 860 is Ile or Val; and the amino acid at position 864 is His or Gln.

In some embodiments the PtIP-83 polypeptide is a variant of SEQ ID NO: 1, wherein the amino acid at position 1 is Met or deleted; the amino acid at position 2 is Ala or deleted; the amino acid at position 3 is Leu, Val, Ile or deleted; the amino acid at position 4 is Val, Met, Ile or Leu; the amino acid at position 7 is Gly, Thr or Ser; the amino acid at position 8 is Lys, Arg, Ser or Thr; the amino acid at position 10 is Phe, Trp or Tyr; the amino acid at position 11 is Glu, Asp, Lys or Arg; the amino acid at position 18 is Met, Val, Leu or Ile; the amino acid at position 19 is Gly, Pro or Ala; the amino acid at position 20 is Val, Ile, Leu or deleted; the amino acid at position 21 is Leu, Ile or Val; the amino acid at position 23 is Arg, Lys, Asn or Gln; the amino acid at position 37 is Val, Ile or Leu; the amino acid at position 38 is Arg, Lys, Gln or Asn; the amino acid at position 40 is Ala, Gly, Thr or Ser; the amino acid at position 43 is Asn, Gln, Glu or Asp; the amino acid at position 45 is Gly or Ala; the amino acid at position 46 is Gln, Asp, Asn or Glu; the amino acid at position 48 is Glu, Asp, Pro, Ile, Leu or Val; the amino acid at position 51 is Glu, Asp, Ala or Gly; the amino acid at position 52 is Lys, Arg, Ser or Thr; the amino acid at position 56 is Leu, Ile or Val; the amino acid at position 59 is Phe, Ile, Val or Leu; the amino acid at position 66 is Pro, Gly or Ala; the amino acid at position 67 is Val, Pro, Ile, Leu, Ser or Thr; the amino acid at position 68 is Val, Arg, Phe, Ile, Leu, Lys or Gly; the amino acid at position 69 is Glu, Ala, Asp, Gly, Arg or Lys; the amino acid at position 70 is Trp, Thr, His, Tyr, Lys or Arg; the amino acid at position 71 is Arg, Pro, Lys or deleted; the amino acid at position 72 is Trp, Asp, Leu, Ile, Val, Glu or deleted; the amino acid at position 73 is Pro, Gln, Asn, His or deleted; the amino acid at position 74 is Pro, Met, Ser or Thr; the amino acid at position 75 is Gln, His, Asn, Lys or Arg; the amino acid at position 76 is Ile, Met, Val or Leu; the amino acid at position 84 is Ile, Leu or Val; the amino acid at position 91 is Trp or Phe; the amino acid at position 93 is Thr, Ser, Leu, Val or Ile; the amino acid at position 94 is Asp, Glu, Ala or Gly; the amino acid at position 96 is Arg, Lys, Thr or Ser; the amino acid at position 97 is Gln, Phe, Asn, Lys or Arg; the amino acid at position 98 is Ser, Thr or deleted; the amino acid at position 99 is Asp, Glu, Gly or Ala; the amino acid at position 100 is Thr, Ser, Gly or Ala; the amino acid at position 101 is Glu, Thr, Asp, Ser or Trp the amino acid at position 103 is His, Arg, Lys, Glu or Gln; the amino acid at position 105 is Thr, Ser or Pro; the amino acid at position 108 is Lys, Arg, Asn, Asp, Gln or Glu; the amino acid at position 109 is Leu, Ile or Val; the amino acid at position 111 is Ala, Ser or Thr; the amino acid at position 112 is Ile, Arg, Thr, Leu, Val, Lys, Ser or deleted; the amino acid at position 113 is Gln, Ala, Gly, Asn or deleted; the amino acid at position 114 is Arg, Glu, Lys, Asp or Ile; the amino acid at position 115 is Glu, Asp, Asn or Gln; the amino acid at position 116 is Glu, Asn, Gln, Asp, Lys or Arg; the amino acid at position 117 is Asn, Val, Tyr, Ile, Leu, Gln, Trp or Phe; the amino acid at position 118 is Arg or Lys; the amino acid at position 119 is Trp, Thr or Ser; the amino acid at position 122 is Thr, Lys, Ser, Arg or Ala; the amino acid at position 124 is Ala, Gly, Ser or Thr; the amino acid at position 126 is Gly, Ala, Glu or Asp; the amino acid at position 127 is Met, Gly or Ala; the amino acid at position 128 is Asn, Gln, Arg or Lys; the amino acid at position 131 is Val, Ile, Leu, Ser or Thr; the amino acid at position 133 is Ile, Leu or Val; the amino acid at position 134 is His or Tyr; the amino acid at position 135 is Ala or Gly; the amino acid at position 137 is Glu, Asp, Arg or Lys; the amino acid at position 139 is Gln, Asn, Asp or Glu; the amino acid at position 140 is Val, Arg, Ile, Lys or Leu; the amino acid at position 141 is Gly, Ala, Thr or Ser; the amino acid at position 142 is Val, Ile, Leu or Pro; the amino acid at position 144 is Thr, Leu, Phe, Ile, Val or Tyr; the amino acid at position 145 is Met, Pro, Gln or Asn; the amino acid at position 146 is Ser, Gly, Thr, Ala, Gln or Asn; the amino acid at position 147 is Trp, Gln, Tyr or Asn; the amino acid at position 148 is Ser, Ala, Thr, Gly or Pro; the amino acid at position 149 is Ser, Thr or deleted; the amino acid at position 150 is Val, Ile, Leu or Tyr; the amino acid at position 152 is Arg, Ala, Val, Ile, Leu, Lys or Gly; the amino acid at position 154 is Ser, Trp, Thr, Asp or Glu; the amino acid at position 156 is Leu, Asp, Ile, Val, Asn, Glu or Gln; the amino acid at position 158 is Ser, Thr or Cys; the amino acid at position 159 is Val, Thr, Leu or Ile; the amino acid at position 162 is Ser, Thr, Gly or Ala; the amino acid at position 163 is Gly, Ala or deleted; the amino acid at position 164 is Phe or deleted; the amino acid at position 165 is Arg, Lys, Gly or Ala; the amino acid at position 166 is Ala, Arg, Met, Lys or Phe; the amino acid at position 167 is Val, Ile, Leu or His; the amino acid at position 168 is Ser, Thr, Gln or Asn; the amino acid at position 169 is Val, His, Ile, Leu, Ser or Thr; the amino acid at position 170 is Phe, Ile, Leu or Val; the amino acid at position 171 is Glu, Asn, Gln or Asp; the amino acid at position 172 is Val, Ala, Arg, Ile, Leu, Gly, Lys, Asp or Glu; the amino acid at position 175 is Ser, Arg, Thr, Lys or Trp; the amino acid at position 176 is Val, Leu or Ile; the amino acid at position 177 is Arg, Lys, Leu, Val or Ile; the amino acid at position 179 is Thr, Ile, Val, Leu or Ser; the amino acid at position 180 is Leu, Phe, Ile, Val, Ser or Thr; the amino acid at position 181 is Gly, Thr, Gln, Asn or Ser; the amino acid at position 182 is Ala, Leu, Phe, Val or Ile; the amino acid at position 183 is Thr, Ser, Ala or Gly; the amino acid at position 184 is Leu, Thr, Ser, Ile, Val, Lys or Arg; the amino acid at position 185 is Arg, Gly, Asp, Lys, Glu or Ala; the amino acid at position 186 is Pro, Val, Ile, Leu, Asn or Gln; the amino acid at position 187 is Asp, Thr, Glu or Ser; the amino acid at position 188 is His, Gly or Ala; the amino acid at position 189 is Ala, Arg, Pro, Lys, Gly or deleted; the amino acid at position 190 is Leu, Asn, Ile, Val, Gln or deleted; the amino acid at position 191 is Tyr or deleted; the amino acid at position 192 is Ser, Ile, Val, Leu, Thr or Asn; the amino acid at position 193 is Thr, Ser, Glu or Asp; the amino acid at position 194 is Thr or Ser; the amino acid at position 195 is Met or Thr; the amino acid at position 196 is Gln, His, Leu, Asn, Ile, Val, Thr or Ser; the amino acid at position 197 is Ala, Gly, Ile, Val or Leu; the amino acid at position 198 is Thr, Glu, Ser, Asp, Gly or Ala; the amino acid at position 199 is Pro, Lys or Arg; the amino acid at position 200 is Asn, Ser, Thr, Gln, Ala or Gly; the amino acid at position 201 is Ala, Leu, Glu, Ile, Asp or Trp; the amino acid at position 202 is Ser, Asp, Phe, Ile, Val, Thr, Glu or Leu; the amino acid at position 203 is His, Pro, Gly, Ala, Thr or Ser; the amino acid at position 204 is Ile, Trp, His, Leu, Val, Ala or Gly; the amino acid at position 205 is Ser, Asn, Leu, Val, Thr, Gln or Ile; the amino acid at position 206 is Ala, Gly, Asp, Tyr, Glu, Lys or Arg; the amino acid at position 207 is Phe, Val, Ile or Leu; the amino acid at position 208 is Asn, Ser, Pro, Gln, Thr, Val, Ile or Leu; the amino acid at position 210 is Arg, Asp, Glu, Lys, Ser or Tyr; the amino acid at position 211 is Ile, Ser, Leu, Val or Thr; the amino acid at position 212 is Val, Ala, Ile, Leu, Glu, Gly or Asp; the amino acid at position 214 is Pro, Lys or Arg; the amino acid at position 215 is Ser or Thr; the amino acid at position 217 is Tyr or Phe; the amino acid at position 218 is Arg, Lys, Thr or Ser; the amino acid at position 219 is Val, Ile, Leu or Ala; the amino acid at position 220 is Cys, Leu, Ile, Val, Thr or Ser; the amino acid at position 221 is Pro or His; the amino acid at position 222 is Leu, Arg, Lys, Ile, Val, Thr or Ser; the amino acid at position 224 is Asn, Gln, Thr or Ser; the amino acid at position 225 is Asp, Arg, Glu, Lys, Ser or Thr; the amino acid at position 226 is Thr, Ser, Gln or Asn; the amino acid at position 227 is Asp, Leu, Glu, Ile, Val or deleted; the amino acid at position 228 is Thr, Ser or deleted; the amino acid at position 229 is Tyr or deleted; the amino acid at position 230 is Leu, Ile, Val or deleted; the amino acid at position 231 is Gly, Ala or deleted; the amino acid at position 232 is Ile, Leu, Val or deleted; the amino acid at position 233 is Pro or deleted; the amino acid at position 234 is Ala, Pro, Gly or deleted; the amino acid at position 235 is Asp, Ile, Leu, Glu or Val; the amino acid at position 236 is Val, Ser, Ile, Leu, Thr, Asp or Glu; the amino acid at position 237 is Ala, Phe or Tyr; the amino acid at position 238 is Ala, Gly, Ser or Thr; the amino acid at position 239 is Val, Ser, Ile, Leu, Thr, Ala or Gly; the amino acid at position 240 is Leu, Val or Ile; the amino acid at position 243 is Asp or Glu; the amino acid at position 249 is Asn, Gln, Thr or Ser; the amino acid at position 252 is Leu, Ile, Val or Met; the amino acid at position 257 is Thr or Ser; the amino acid at position 259 is His, Ile, Val or Leu; the amino acid at position 266 is Ala, Ile, Leu or Val; the amino acid at position 267 is Cys, Ala or Gly; the amino acid at position 268 is His, Arg, Lys or Tyr; the amino acid at position 272 is Asp or Glu; the amino acid at position 273 is Val, Met, Ile or Leu; the amino acid at position 274 is Val, Ile, Leu or Met; the amino acid at position 278 is Gly or Ala; the amino acid at position 279 is Glu, Asp, Gly or Val; the amino acid at position 281 is Leu, Ile, Val, Gly or Ala; the amino acid at position 282 is Asn, Leu or Ile; the amino acid at position 285 is Asn, Gln, Thr or Ser; the amino acid at position 286 is Lys, Asp, Arg or Glu; the amino acid at position 287 is Leu, Ile or Val; the amino acid at position 290 is Pro, Gln, Asn, Lys or Arg; the amino acid at position 291 is Leu, Ile or Val; the amino acid at position 292 is Lys, Arg, Ile, Leu or Val; the amino acid at position 293 is Glu, Asp, Asn or Gln; the amino acid at position 294 is Ser, Asn, Thr, Gln, Arg or Lys; the amino acid at position 295 is Thr or Ser; the amino acid at position 296 is Gln, Asn or His; the amino acid at position 297 is Leu, Ile, Val or Met; the amino acid at position 300 is Ser or Thr; the amino acid at position 301 is Glu, Asp, Gly or Ala; the amino acid at position 302 is Ser, Pro, Thr, Gly or Ala; the amino acid at position 304 is Lys, Arg, Gln or Asn; the amino acid at position 313 is Val, Leu or Ile; the amino acid at position 314 is His, Glu, Asn, Asp or Gln; the amino acid at position 315 is Ala, Cys, Gly, Thr or Ser; the amino acid at position 316 is Ala, Ile, Leu or Val; the amino acid at position 317 is Met, Leu, Val or Ile; the amino acid at position 319 is Met, Leu, Val or Ile; the amino acid at position 320 is Val, Ile, Leu, Ala or Gly; the amino acid at position 321 is Arg, Lys or Pro; the amino acid at position 322 is Ile, Leu, Val or Phe; the amino acid at position 323 is Gly, Ile, Leu or Val; the amino acid at position 324 is Leu, Ile, Val, Thr or Ser; the amino acid at position 336 is Ser, Thr, Gln or Asn; the amino acid at position 339 is Asn, Lys, Gln or Arg; the amino acid at position 350 is Arg, Lys, Asn or Gln; the amino acid at position 351 is Glu or Asp; the amino acid at position 353 is Lys or Arg; the amino acid at position 354 is Gln, Asn, Lys or Arg; the amino acid at position 355 is Phe, Ile, Leu or Leu; the amino acid at position 356 is Lys or Arg; the amino acid at position 360 is Ile, Val, Leu, Gly or Ala; the amino acid at position 365 is Leu, Ile, Val or Phe; the amino acid at position 371 is or Glu or Asp; the amino acid at position 372 is or Lys or Arg; the amino acid at position 374 is Arg or Lys; the amino acid at position 376 is Phe, Ile, Val or Leu; the amino acid at position 378 is Glu or Asp; the amino acid at position 381 is Leu, Ile or Val; the amino acid at position 388 is Ala, Thr, Gly or Ser; the amino acid at position 395 is Arg or Lys; the amino acid at position 396 is Glu, Gln, Asp, Asn, Ala or Gly; the amino acid at position 399 is Asp, Gln, Glu or Asn; the amino acid at position 400 is Asn, Thr, Ser, Glu, Gln or Asp; the amino acid at position 401 is Thr, Ser, Gly or Ala; the amino acid at position 402 is Phe, Ile, Val or Leu; the amino acid at position 406 is Asp or Glu; the amino acid at position 408 is Leu, Ile, Val or Met; the amino acid at position 410 is Gly, Ile, Val, Ala or Leu; the amino acid at position 414 is Ala, Gly, Asp or Glu; the amino acid at position 416 is Ser, Asn, Thr, Gln, Glu or Asp; the amino acid at position 417 is Ser, Arg, Lys, Thr, Ala or Gly; the amino acid at position 423 is Lys, Arg, Asn or Gln; the amino acid at position 431 is Arg or Lys; the amino acid at position 432 is Gln, Asn, Asp or Glu; the amino acid at position 436 is Arg, Lys, Asp or Glu; the amino acid at position 440 is Asn, Gln, Lys or Arg; the amino acid at position 442 is Leu, Ile or Val; the amino acid at position 447 is Ser, Lys, Thr or Arg; the amino acid at position 448 is Ala, Gly, Thr or Ser; the amino acid at position 451 is Gln, Asn or Met; the amino acid at position 453 is Gly or Ala; the amino acid at position 455 is Ala, Leu, Ile or Val; the amino acid at position 457 is Leu, Ile or Val; the amino acid at position 467 is Val, Ile, Leu, Gly or Ala; the amino acid at position 471 is Gly or Ala; the amino acid at position 475 is Ser, Thr, Gln or Asn; the amino acid at position 483 is Gly or Ala; the amino acid at position 493 is Gln, Asn or Gly; the amino acid at position 504 is Val, Leu or Ile; the amino acid at position 506 is Asp, Glu or His; the amino acid at position 509 is Asp, Glu, Gln or Asn; the amino acid at position 510 is Ser, Thr, Gly or Ala; the amino acid at position 512 is Glu or Asp; the amino acid at position 515 is Gly, Ala, Thr or Ser; the amino acid at position 516 is Gln, Asn or His; the amino acid at position 517 is Ile, Val or Leu; the amino acid at position 519 is Asp, Asn, Glu, Gly or Gln; the amino acid at position 522 is Val, Glu, Pro, Ile, Leu or Asp; the amino acid at position 525 is Glu or Asp; the amino acid at position 526 is Leu, Ile, Val or Met; the amino acid at position 539 is Val, Leu or Ile; the amino acid at position 555 is Val, Leu, Ile or Ala; the amino acid at position 557 is Arg or Lys; the amino acid at position 563 is Val, Leu, Ile or Met; the amino acid at position 571 is Ser, Thr or Cys; the amino acid at position 575 is Val, Leu, Ile, Asp or Glu; the amino acid at position 577 is Met, Leu, Val or Ile; the amino acid at position 579 is Glu, Asp, Asn or Gln; the amino acid at position 583 is Asp or Glu; the amino acid at position 589 is Met, Ile, Val or Leu; the amino acid at position 590 is Met, Ile, Val or Leu; the amino acid at position 593 is Met, Leu, Val or Ile; the amino acid at position 595 is Arg, Lys, Asn or Gln; the amino acid at position 596 is Ser or Thr; the amino acid at position 597 is Gln, Asn or His; the amino acid at position 607 is Ala, Gly, Ile, Leu or Val; the amino acid at position 608 is Asp, Glu, Gln or Asn; the amino acid at position 612 is Tyr, His or Phe; the amino acid at position 617 is Thr, Ser, Leu, Val or Ile; the amino acid at position 618 is Gln, Asn or His; the amino acid at position 625 is Arg, Lys, Thr or Ser; the amino acid at position 626 is Met, Leu, Val or Ile; the amino acid at position 628 is Leu, Val or Ile; the amino acid at position 633 is Ile, Leu, Val or Met; the amino acid at position 634 is Leu, Ile, Val or Met; the amino acid at position 642 is Arg, Lys or Met; the amino acid at position 648 is Met, Ser or Thr; the amino acid at position 651 is Glu, Asp, Asn or Gln; the amino acid at position 654 is Thr, Val, Ser, Ile, Leu, Gly or Ala; the amino acid at position 658 is Gly, Lys, Ala or Arg;

the amino acid at position 663 is Gly or Ala; the amino acid at position 664 is Asp, Glu, Gln or Asn; the amino acid at position 668 is Ala, Gly, Ser or Thr; the amino acid at position 669 is Gln, Asn or His; the amino acid at position 671 is Asn, Gln, Thr or Ser the amino acid at position 675 is Ile, Val, Ile, Thr or Ser; the amino acid at position 678 is Met, Ile, Ala, Leu, Ser or Thr; the amino acid at position 682 is Pro, Asn or Gln; the amino acid at position 683 is Ser, Thr or Pro; the amino acid at position 685 is Asp, Glu, Asp or Asn; the amino acid at position 694 is Asp, Glu, Ala or Gly; the amino acid at position 697 is Asn, Gln, Thr or Ser; the amino acid at position 704 is Glu, Asp, Ala or Gly; the amino acid at position 714 is Ala or Gly; the amino acid at position 721 is Ser, Thr or Phe; the amino acid at position 722 is Ser, Thr, Gln or Asn; the amino acid at position 724 is Ser or Thr; the amino acid at position 734 is His, Asn or Gln; the amino acid at position 736 is Val, Leu, Ile or Ala; the amino acid at position 737 is Lys, Arg, Asn or Gln; the amino acid at position 739 is Ala, Gly, Thr or Ser; the amino acid at position 740 is Ser, Thr or Met; the amino acid at position 741 is Gly, Ala, Gln or Asn; the amino acid at position 742 is Ile, Leu, Val, Ala or Gly; the amino acid at position 743 is Gly or deleted; the amino acid at position 745 is Gly, Ala, Glu or Asp; the amino acid at position 751 is Thr, Ser, Gly or Ala; the amino acid at position 753 is Gln, Asn, Lys or Arg; the amino acid at position 754 is Thr or Ser; the amino acid at position 756 is Thr, Ser, Leu, Val or Ile; the amino acid at position 757 is Val, Leu or Ile; the amino acid at position 766 is Ile, Leu or Val; the amino acid at position 773 is Asp or Glu; the amino acid at position 774 is Gln, Asn, Asp or Glu; the amino acid at position 776 is Leu, Ile, Val or Met; the amino acid at position 777 is Pro, Ser or Thr; the amino acid at position 782 is Ala, Asp, Glu, Ile, Leu or Val; the amino acid at position 786 is Tyr or Phe; the amino acid at position 787 is His, Asn or Gln; the amino acid at position 788 is Tyr or Met; the amino acid at position 789 is Ala, Lys or Arg; the amino acid at position 790 is Tyr or Thr; the amino acid at position 791 is Arg, Lys, Gly or Ala; the amino acid at position 792 is Leu, Ile, Val, Thr or Ser; the amino acid at position 796 is Asp or Glu; the amino acid at position 797 is Ser, Thr or Ala the amino acid at position 802 is Glu, Lys, Asp, Asn or Gln; the amino acid at position 806 is Gln, Asp, Glu, Asn or His; the amino acid at position 810 is Lys, Arg or Thr; the amino acid at position 819 is Arg, Lys or His; the amino acid at position 829 is Lys, Ser, Ala or Pro; the amino acid at position 832 is Ala, Lys, Arg, Asp or Glu; the amino acid at position 833 is Gly, Ala, Asp or Glu; the amino acid at position 842 is Leu, Ile, Val or Pro; the amino acid at position 847 is Gln, Asn, Asp or Glu; the amino acid at position 848 is Ile, Leu or Val; the amino acid at position 849 is Val, Leu, Ile, Gly or Ala; the amino acid at position 855 is Thr, Ser or Met; the amino acid at position 860 is Ile, Leu or Val; the amino acid at position 864 is His, Asn or Gln;

In some embodiments the PtIP-83 polypeptide is a variant of SEQ ID NO: 1, wherein the amino acid at position 1 is Met or deleted; the amino acid at position 2 is Ala or deleted; the amino acid at position 3 is Leu, Val, Ile or deleted; the amino acid at position 4 is Val, Met, Ile or Leu; the amino acid at position 7 is Gly, Thr or Ser; the amino acid at position 8 is Lys, Arg, Ser or Thr; the amino acid at position 10 is Phe, Trp or Tyr; the amino acid at position 11 is Glu, Asp, Lys or Arg; the amino acid at position 18 is Met, Val, Leu or Ile; the amino acid at position 19 is Gly, Pro or Ala; the amino acid at position 20 is Val, Ile, Leu or deleted; the amino acid at position 21 is Leu, Ile or Val; the amino acid at position 23 is Arg, Lys, Asn or Gln; the amino acid at position 37 is Val, Ile or Leu; the amino acid at position 38 is Arg, Lys, Gln or Asn; the amino acid at position 40 is Ala, Gly, Thr or Ser; the amino acid at position 43 is Asn, Gln, Glu or Asp; the amino acid at position 45 is Gly or Ala; the amino acid at position 46 is Gln, Asp, Asn or Glu; the amino acid at position 48 is Glu, Asp, Pro, Ile, Leu or Val; the amino acid at position 51 is Glu, Asp, Ala or Gly; the amino acid at position 52 is Lys, Arg, Ser or Thr; the amino acid at position 53 is Val, Ala, Cys or Thr; the amino acid at position 54 is Lys, Ala, Cys, Asp, Glu, Gly, His, Ile, Leu, Met, Asn, Gln, Arg, Ser or Thr; the amino acid at position 55 is Arg, Ala, Asp, Glu, Phe, Gly, His, Lys, Leu, Met, Asn, Gln, Ser, Thr, Val, Trp or Tyr; the amino acid at position 56 is Leu, Glu, Phe, Ile, Met, Thr or Val; the amino acid at position 57 is Tyr, Cys, Ile, Leu, Met, Thr or Val; the amino acid at position 58 is Val, Cys, Ile or Leu; the amino acid at position 59 is Phe, Leu, Met, Val or Tyr; the amino acid at position 60 is Ala, Cys, Gly, Ser, Thr or Val; the amino acid at position 61 is Asp, Glu, His or Ser; the amino acid at position 62 is Val, Ala, Cys, Ile, Leu or Thr; the amino acid at position 63 is Val, Ala, Cys, Ile, Leu, Met or Thr; the amino acid at position 64 is Glu, Ala, Cys, Phe, Gly, His, Ile, Leu, Met, Asn, Gln, Arg, Ser, Thr, Val, Trp or Tyr; the amino acid at position 65 is Leu, Ala, Cys, Phe, His, Ile, Met, Asn, Gln, Thr, Val or Trp; the amino acid at position 66 is Pro, Asp, Gly, Met, Gln or Arg; the amino acid at position 67 is Val, Pro, Ile, Leu, Ser or Thr; the amino acid at position 68 is Val, Arg, Phe, Ile, Leu, Lys or Gly; the amino acid at position 69 is Glu, Ala, Asp, Gly, Arg or Lys; the amino acid at position 70 is Trp, Thr, His, Tyr, Lys or Arg; the amino acid at position 71 is Arg, Pro, Lys or deleted; the amino acid at position 72 is Trp, Asp, Leu, Ile, Val, Glu or deleted; the amino acid at position 73 is Pro, Gln, Asn, His or deleted; the amino acid at position 74 is Pro, Met, Ser or Thr; the amino acid at position 75 is Gln, His, Asn, Lys or Arg; the amino acid at position 76 is Ile, Met, Val or Leu; the amino acid at position 84 is Ile, Leu or Val; the amino acid at position 91 is Trp or Phe; the amino acid at position 93 is Thr, Ser, Leu, Val or Ile; the amino acid at position 94 is Asp, Glu, Ala or Gly; the amino acid at position 96 is Arg, Lys, Thr or Ser; the amino acid at position 97 is Gln, Phe, Asn, Lys or Arg; the amino acid at position 98 is Ser, Thr or deleted; the amino acid at position 99 is Asp, Glu, Gly or Ala; the amino acid at position 100 is Thr, Ser, Gly or Ala; the amino acid at position 101 is Glu, Thr, Asp, Ser or Trp the amino acid at position 103 is His, Arg, Lys, Glu or Gln; the amino acid at position 105 is Thr, Ser or Pro; the amino acid at position 108 is Lys, Arg, Asn, Asp, Gln or Glu; the amino acid at position 109 is Leu, Ile or Val; the amino acid at position 111 is Ala, Ser or Thr; the amino acid at position 112 is Ile, Arg, Thr, Leu, Val, Lys, Ser or deleted; the amino acid at position 113 is Gln, Ala, Gly, Asn or deleted; the amino acid at position 114 is Arg, Glu, Lys, Asp or Ile; the amino acid at position 115 is Glu, Asp, Asn or Gln; the amino acid at position 116 is Glu, Asn, Gln, Asp, Lys or Arg; the amino acid at position 117 is Asn, Val, Tyr, Ile, Leu, Gln, Trp or Phe; the amino acid at position 118 is Arg or Lys; the amino acid at position 119 is Trp, Thr or Ser; the amino acid at position 122 is Thr, Lys, Ser, Arg or Ala; the amino acid at position 124 is Ala, Gly, Ser or Thr; the amino acid at position 126 is Gly, Ala, Glu or Asp; the amino acid at position 127 is Met, Gly or Ala; the amino acid at position 128 is Asn, Gln, Arg or Lys; the amino acid at position 131 is Val, Ile, Leu, Ser or Thr; the amino acid at position 133 is Ile, Leu or Val; the amino acid at position 134 is His or Tyr; the amino acid at position 135 is Ala or Gly; the amino acid at position 137 is Glu, Asp, Arg or Lys; the amino acid at position 139 is Gln, Asn, Asp or Glu; the amino acid at position 140 is Val, Arg, Ile, Lys or Leu; the amino acid at position 141 is Gly, Ala, Thr or Ser; the amino acid at position 142 is Val, Ile, Leu or Pro; the amino acid at position 144 is Thr, Leu, Phe, Ile, Val or Tyr; the amino acid at position 145 is Met, Pro, Gln or Asn; the amino acid at position 146 is Ser, Gly, Thr, Ala, Gln or Asn; the amino acid at position 147 is Trp, Gln, Tyr or Asn; the amino acid at position 148 is Ser, Ala, Thr, Gly or Pro; the amino acid at position 149 is Ser, Thr or deleted; the amino acid at position 150 is Val, Ile, Leu or Tyr; the amino acid at position 152 is Arg, Ala, Val, Ile, Leu, Lys or Gly; the amino acid at position 154 is Ser, Trp, Thr, Asp or Glu; the amino acid at position 156 is Leu, Asp, Ile, Val, Asn, Glu or Gln; the amino acid at position 158 is Ser, Thr or Cys; the amino acid at position 159 is Val, Thr, Leu or Ile; the amino acid at position 162 is Ser, Thr, Gly or Ala; the amino acid at position 163 is Gly, Ala or deleted; the amino acid at position 164 is Phe or deleted; the amino acid at position 165 is Arg, Lys, Gly or Ala; the amino acid at position 166 is Ala, Arg, Met, Lys or Phe; the amino acid at position 167 is Val, Ile, Leu or His; the amino acid at position 168 is Ser, Thr, Gln or Asn; the amino acid at position 169 is Val, His, Ile, Leu, Ser or Thr; the amino acid at position 170 is Phe, Ile, Leu or Val; the amino acid at position 171 is Glu, Asn, Gln or Asp; the amino acid at position 172 is Val, Ala, Arg, Ile, Leu, Gly, Lys, Asp or Glu; the amino acid at position 175 is Ser, Arg, Thr, Lys or Trp; the amino acid at position 176 is Val, Leu or Ile; the amino acid at position 177 is Arg, Lys, Leu, Val or Ile; the amino acid at position 179 is Thr, Ile, Val, Leu or Ser; the amino acid at position 180 is Leu, Phe, Ile, Val, Ser or Thr; the amino acid at position 181 is Gly, Thr, Gln, Asn or Ser; the amino acid at position 182 is Ala, Leu, Phe, Val or Ile; the amino acid at position 183 is Thr, Ser, Ala or Gly; the amino acid at position 184 is Leu, Thr, Ser, Ile, Val, Lys or Arg; the amino acid at position 185 is Arg, Gly, Asp, Lys, Glu or Ala; the amino acid at position 186 is Pro, Val, Ile, Leu, Asn or Gln; the amino acid at position 187 is Asp, Thr, Glu or Ser; the amino acid at position 188 is His, Gly or Ala; the amino acid at position 189 is Ala, Arg, Pro, Lys, Gly or deleted; the amino acid at position 190 is Leu, Asn, Ile, Val, Gln or deleted; the amino acid at position 191 is Tyr or deleted; the amino acid at position 192 is Ser, Ile, Val, Leu, Thr or Asn; the amino acid at position 193 is Thr, Ser, Glu or Asp; the amino acid at position 194 is Thr or Ser; the amino acid at position 195 is Met or Thr; the amino acid at position 196 is Gln, His, Leu, Asn, Ile, Val, Thr or Ser; the amino acid at position 197 is Ala, Gly, Ile, Val or Leu; the amino acid at position 198 is Thr, Glu, Ser, Asp, Gly or Ala; the amino acid at position 199 is Pro, Lys or Arg; the amino acid at position 200 is Asn, Ser, Thr, Gln, Ala or Gly; the amino acid at position 201 is Ala, Leu, Glu, Ile, Asp or Trp; the amino acid at position 202 is Ser, Asp, Phe, Ile, Val, Thr, Glu or Leu; the amino acid at position 203 is His, Pro, Gly, Ala, Thr or Ser; the amino acid at position 204 is Ile, Trp, His, Leu, Val, Ala or Gly; the amino acid at position 205 is Ser, Asn, Leu, Val, Thr, Gln or Ile; the amino acid at position 206 is Ala, Gly, Asp, Tyr, Glu, Lys or Arg; the amino acid at position 207 is Phe, Val, Ile or Leu; the amino acid at position 208 is Asn, Ser, Pro, Gln, Thr, Val, Ile or Leu; the amino acid at position 210 is Arg, Asp, Glu, Lys, Ser or Tyr; the amino acid at position 211 is Ile, Ser, Leu, Val or Thr; the amino acid at position 212 is Val, Ala, Ile, Leu, Glu, Gly or Asp; the amino acid at position 214 is Pro, Lys or Arg; the amino acid at position 215 is Ser or Thr; the amino acid at position 217 is Tyr or Phe; the amino acid at position 218 is Arg, Lys, Thr or Ser; the amino acid at position 219 is Val, Ile, Leu or Ala; the amino acid at position 220 is Cys, Leu, Ile, Val, Thr or Ser; the amino acid at position 221 is Pro or His; the amino acid at position 222 is Leu, Arg, Lys, Ile, Val, Thr or Ser; the amino acid at position 224 is Asn, Gln, Thr or Ser; the amino acid at position 225 is Asp, Arg, Glu, Lys, Ser or Thr; the amino acid at position 226 is Thr, Ser, Gln or Asn; the amino acid at position 227 is Asp, Leu, Glu, Ile, Val or deleted; the amino acid at position 228 is Thr, Ser or deleted; the amino acid at position 229 is Tyr or deleted; the amino acid at position 230 is Leu, Ile, Val or deleted; the amino acid at position 231 is Gly, Ala or deleted; the amino acid at position 232 is Ile, Leu, Val or deleted; the amino acid at position 233 is Pro or deleted; the amino acid at position 234 is Ala, Pro, Gly or deleted; the amino acid at position 235 is Asp, Ile, Leu, Glu or Val; the amino acid at position 236 is Val, Ser, Ile, Leu, Thr, Asp or Glu; the amino acid at position 237 is Ala, Phe or Tyr; the amino acid at position 238 is Ala, Gly, Ser or Thr; the amino acid at position 239 is Val, Ser, Ile, Leu, Thr, Ala or Gly; the amino acid at position 240 is Leu, Val or Ile; the amino acid at position 243 is Asp or Glu; the amino acid at position 249 is Asn, Gln, Thr or Ser; the amino acid at position 252 is Leu, Ile, Val or Met; the amino acid at position 257 is Thr or Ser; the amino acid at position 259 is His, Ile, Val or Leu; the amino acid at position 266 is Ala, Ile, Leu or Val; the amino acid at position 267 is Cys, Ala or Gly; the amino acid at position 268 is His, Arg, Lys or Tyr; the amino acid at position 272 is Asp or Glu; the amino acid at position 273 is Val, Met, Ile or Leu; the amino acid at position 274 is Val, Ile, Leu or Met; the amino acid at position 278 is Gly or Ala; the amino acid at position 279 is Glu, Asp, Gly or Val; the amino acid at position 281 is Leu, Ile, Val, Gly or Ala; the amino acid at position 282 is Asn, Leu or Ile; the amino acid at position 285 is Asn, Gln, Thr or Ser; the amino acid at position 286 is Lys, Asp, Arg or Glu; the amino acid at position 287 is Leu, Ile or Val; the amino acid at position 290 is Pro, Gln, Asn, Lys or Arg; the amino acid at position 291 is Leu, Ile or Val; the amino acid at position 292 is Lys, Arg, Ile, Leu or Val; the amino acid at position 293 is Glu, Asp, Asn or Gln; the amino acid at position 294 is Ser, Asn, Thr, Gln, Arg or Lys; the amino acid at position 295 is Thr or Ser; the amino acid at position 296 is Gln, Asn or His; the amino acid at position 297 is Leu, Ile, Val or Met; the amino acid at position 300 is Ser or Thr; the amino acid at position 301 is Glu, Asp, Gly or Ala; the amino acid at position 302 is Ser, Pro, Thr, Gly or Ala; the amino acid at position 304 is Lys, Arg, Gln or Asn; the amino acid at position 313 is Val, Leu or Ile; the amino acid at position 314 is His, Glu, Asn, Asp or Gln; the amino acid at position 315 is Ala, Cys, Gly, Thr or Ser; the amino acid at position 316 is Ala, Ile, Leu or Val; the amino acid at position 317 is Met, Leu, Val or Ile; the amino acid at position 319 is Met, Leu, Val or Ile; the amino acid at position 320 is Val, Ile, Leu, Ala or Gly; the amino acid at position 321 is Arg, Lys or Pro; the amino acid at position 322 is Ile, Leu, Val or Phe; the amino acid at position 323 is Gly, Ile, Leu or Val; the amino acid at position 324 is Leu, Ile, Val, Thr or Ser; the amino acid at position 336 is Ser, Thr, Gln or Asn; the amino acid at position 339 is Asn, Lys, Gln or Arg; the amino acid at position 350 is Arg, Lys, Asn or Gln; the amino acid at position 351 is Glu or Asp; the amino acid at position 353 is Lys or Arg; the amino acid at position 354 is Gln, Asn, Lys or Arg; the amino acid at position 355 is Phe, Ile, Leu or Leu; the amino acid at position 356 is Lys or Arg; the amino acid at position 360 is Ile, Val, Leu, Gly or Ala; the amino acid at position 363 is Gln, Ala, Cys, Glu, Phe, Gly, His, Lys, Leu, Asn, Arg, Ser, Thr, Val or Trp; the amino acid at position 364 is Ile, Ala, Cys, Glu, Phe, His, Lys, Leu, Met, Asn, Gln, Ser, Thr, Val, Trp or Tyr; the amino acid at position 365 is Leu, Ala, Glu, Phe, Gly, His, Ile, Lys, Met, Asn, Arg, Val, Trp or Tyr; the amino acid at position 366 is Gly, Ala, Cys, Phe, His, Ile, Lys, Leu, Met, Asn, Ser, Thr or Val; the amino acid at position 367 is Ser, Ala, Cys, Asp, Glu, Phe, Gly, His, Ile, Leu, Met, Asn, Pro, Gln, Arg, Thr, Val or Trp; the amino acid at position 368 is Tyr, Ala, Cys, Asp, Glu, Phe, Gly, His, Ile, Lys, Leu, Met, Asn, Pro, Gln, Arg, Ser, Thr, Val or Trp; the amino acid at position 369 is Leu, Ala, Cys, Asp, Phe, Gly, Ile, Met, Thr or Val; the amino acid at position 370 is Leu, Ala, Cys, Asp, Glu, Phe, Gly, His, Ile, Lys, Met, Gln, Arg, Ser, Thr, Val, Trp or Tyr; the amino acid at position 371 is Gln, Ala, Cys, Asp, Glu, Phe, Gly, Ile, Lys, Leu, Asn, Arg, Ser, Thr, Val or Trp; the amino acid at position 372 is Gln, Ala, Cys, Asp, Phe, Gly, His, Ile, Leu, Asn, Arg, Ser, Val or Tyr; the amino acid at position 373 is Asn, Ala, Cys, Asp, Phe, Gly, His, Ile, Lys, Gln, Ser, Thr, Val or Trp; the amino acid at position 374 is Arg or Lys; the amino acid at position 376 is Phe, Ile, Val or Leu; the amino acid at position 378 is Glu or Asp; the amino acid at position 381 is Leu, Ile or Val; the amino acid at position 388 is Ala, Thr, Gly or Ser; the amino acid at position 395 is Arg or Lys; the amino acid at position 396 is Glu, Gln, Asp, Asn, Ala or Gly; the amino acid at position 399 is Asp, Gln, Glu or Asn; the amino acid at position 400 is Asn, Thr, Ser, Glu, Gln or Asp; the amino acid at position 401 is Thr, Ser, Gly or Ala; the amino acid at position 402 is Phe, Ile, Val or Leu; the amino acid at position 406 is Asp or Glu; the amino acid at position 408 is Leu, Ile, Val or Met; the amino acid at position 410 is Gly, Ile, Val, Ala or Leu; the amino acid at position 414 is Ala, Gly, Asp or Glu; the amino acid at position 416 is Ser, Asn, Thr, Gln, Glu or Asp; the amino acid at position 417 is Ser, Arg, Lys, Thr, Ala or Gly; the amino acid at position 423 is Lys, Arg, Asn or Gln; the amino acid at position 431 is Arg or Lys; the amino acid at position 432 is Gln, Asn, Asp or Glu; the amino acid at position 436 is Arg, Lys, Asp or Glu; the amino acid at position 440 is Asn, Gln, Lys or Arg; the amino acid at position 442 is Leu, Ile or Val; the amino acid at position 447 is Ser, Lys, Thr or Arg; the amino acid at position 448 is Ala, Gly, Thr or Ser; the amino acid at position 451 is Gln, Asn or Met; the amino acid at position 453 is Gly or Ala; the amino acid at position 455 is Ala, Leu, Ile or Val; the amino acid at position 457 is Leu, Ile or Val; the amino acid at position 467 is Val, Ile, Leu, Gly or Ala; the amino acid at position 471 is Gly or Ala; the amino acid at position 475 is Ser, Thr, Gln or Asn; the amino acid at position 483 is Gly or Ala; the amino acid at position 493 is Gln, Asn or Gly; the amino acid at position 504 is Val, Leu or Ile; the amino acid at position 506 is Asp, Glu or His; the amino acid at position 509 is Asp, Glu, Gln or Asn; the amino acid at position 510 is Ser, Thr, Gly or Ala; the amino acid at position 512 is Glu or Asp; the amino acid at position 515 is Gly, Ala, Thr or Ser; the amino acid at position 516 is Gln, Asn or His; the amino acid at position 517 is Ile, Val or Leu; the amino acid at position 519 is Asp, Asn, Glu, Gly or Gln; the amino acid at position 522 is Val, Glu, Pro, Ile, Leu or Asp; the amino acid at position 525 is Glu or Asp; the amino acid at position 526 is Leu, Ile, Val or Met; the amino acid at position 539 is Val, Leu or Ile; the amino acid at position 555 is Val, Leu, Ile or Ala; the amino acid at position 556 is Trp, Phe, Thr or Tyr; the amino acid at position 557 is Arg, Cys, Asp, Gly, His, Ile, Lys, Leu, Met, Asn, Pro, Gln, Ser, Thr, Val, Trp or Tyr; the amino acid at position 558 is Ala, Cys, Asp, Phe, Gly, His, Ile, Lys, Leu, Asn, Pro, Gln, Arg, Ser, Val, Trp or Tyr; the amino acid at position 559 is Lys, Ala, Cys, Phe, Gly, His, Ile, Leu, Asn, Gln, Arg, Ser, Thr, Val or Tyr; the amino acid at position 560 is Cys, Ala, Phe, Gly, Ile, Met, Asn, Arg, Ser, Thr or Val; the amino acid at position 561 is Lys, Ala, Cys, Asp, Glu, Phe, Gly, His, Ile, Leu, Met, Asn, Arg, Ser, Thr, Val or Tyr; the amino acid at position 562 is Asn, Cys, Asp, Glu, Gly, His, Leu, Met, Arg, Ser, Thr, Val or Tyr; the amino acid at position 563 is Val, Ala, Cys, Asp, Phe, His, Ile, Leu, Met, Asn, Gln, Thr or Trp; the amino acid at position 564 is Ala, Cys, Gly, Met, Gln, Ser, Thr, Val, Trp or Tyr; the amino acid at position 571 is Ser, Thr or Cys; the amino acid at position 575 is Val, Leu, Ile, Asp or Glu; the amino acid at position 577 is Met, Leu, Val or Ile; the amino acid at position 579 is Glu, Asp, Asn or Gln; the amino acid at position 583 is Asp or Glu; the amino acid at position 589 is Met, Ile, Val or Leu; the amino acid at position 590 is Met, Ile, Val or Leu; the amino acid at position 593 is Met, Leu, Val or Ile; the amino acid at position 595 is Arg, Lys, Asn or Gln; the amino acid at position 596 is Ser or Thr; the amino acid at position 597 is Gln, Asn or His; the amino acid at position 607 is Ala, Gly, Ile, Leu or Val; the amino acid at position 608 is Asp, Glu, Gln or Asn; the amino acid at position 612 is Tyr, His or Phe; the amino acid at position 617 is Thr, Ser, Leu, Val or Ile; the amino acid at position 618 is Gln, Asn or His; the amino acid at position 625 is Arg, Lys, Thr or Ser; the amino acid at position 626 is Met, Leu, Val or Ile; the amino acid at position 628 is Leu, Val or Ile; the amino acid at position 633 is Ile, Leu, Val or Met; the amino acid at position 634 is Leu, Ile, Val or Met; the amino acid at position 642 is Arg, Lys or Met; the amino acid at position 646 is Leu, Ala, Cys, Gly, Ile, Met, Asn, Gln, Ser, Thr or Val; the amino acid at position 647 is Leu, Asp, Gly, Met, Asn, Gln or Thr; the amino acid at position 648 is Met, Ala, Cys, Asp, Glu, Phe, Gly, His, Lys, Leu, Asn, Pro, Gln, Arg, Ser, Thr, Val, Trp or Tyr; the amino acid at position 649 is Pro, Ala, Cys, Asp, Glu, Phe, Gly, His, Lys, Met, Asn, Gln, Arg, Ser, Thr, Trp or Tyr; the amino acid at position 650 is Thr, Ala, Cys, Asp, Phe, Gly, His, Ile, Lys, Leu, Met, Pro, Gln, Arg, Ser, Val or Tyr; the amino acid at position 651 is Glu, Ala, Cys, Asp, Gly, His, Ile, Leu, Met, Asn, Pro, Gln, Arg, Ser, Thr, Val or Tyr; the amino acid at position 652 is Leu, Cys, Phe, Ile, Lys, Met, Pro, Arg, Ser, Thr or Val; the amino acid at position 653 is Thr, Cys, Asp, Glu, Phe, Gly, His, Ile, Lys, Leu, Pro, Arg, Ser, Val or Trp; the amino acid at position 654 is Thr, Ala, Cys, Phe, Ile, Lys, Leu, Met, Pro, Arg, Ser, Val, Trp or Tyr; the amino acid at position 655 is Trp, Phe or Tyr; the amino acid at position 658 is Gly, Lys, Ala or Arg; the amino acid at position 663 is Gly or Ala; the amino acid at position 664 is Asp, Glu, Gln or Asn; the amino acid at position 668 is Ala, Gly, Ser or Thr; the amino acid at position 669 is Gln, Asn or His; the amino acid at position 671 is Asn, Gln, Thr or Ser the amino acid at position 675 is Ile, Val, Ile, Thr or Ser; the amino acid at position 678 is Met, Ile, Ala, Leu, Ser or Thr; the amino acid at position 682 is Pro, Asn or Gln; the amino acid at position 683 is Ser, Thr or Pro; the amino acid at position 685 is Asp, Glu, Asp or Asn; the amino acid at position 694 is Asp, Glu, Ala or Gly; the amino acid at position 697 is Asn, Gln, Thr or Ser; the amino acid at position 704 is Glu, Asp, Ala or Gly; the amino acid at position 714 is Ala or Gly; the amino acid at position 721 is Ser, Thr or Phe; the amino acid at position 722 is Ser, Thr, Gln or Asn; the amino acid at position 724 is Ser or Thr; the amino acid at position 734 is His, Asn or Gln; the amino acid at position 736 is Val, Leu, Ile or Ala; the amino acid at position 737 is Lys, Arg, Asn or Gln; the amino acid at position 739 is Ala, Gly, Thr or Ser; the amino acid at position 740 is Ser, Thr or Met; the amino acid at position 741 is Gly, Ala, Gln or Asn; the amino acid at position 742 is Ile, Leu, Val, Ala or Gly; the amino acid at position 743 is Gly or deleted; the amino acid at position 745 is Gly, Ala, Glu or Asp; the amino acid at position 751 is Thr, Ser, Gly or Ala; the amino acid at position 753 is Gln, Asn, Lys or Arg; the amino acid at position 754 is Thr or Ser; the amino acid at position 756 is Thr, Ser, Leu, Val or Ile; the amino acid at position 757 is Val, Leu or Ile; the amino acid at position 766 is Ile, Leu or Val; the amino acid at position 771 is Arg, Ala, Asp, Glu, Phe, Gly, His, Ile, Lys, Leu, Asn, Ser, Thr, Val, Trp or Tyr; the amino acid at position 772 is Arg, Ala, Cys, Asp, Glu, Phe, Gly, His, Ile, Lys, Leu, Met, Pro, Gln, Ser, Thr, Val, Trp or Tyr; the amino acid at position 773 is Asp, Ala, Glu, Phe, Gly, His, Ile, Lys, Leu, Met, Asn, Gln, Arg, Ser, Thr, Val, Trp or Tyr; the amino acid at position 774 is Gln, Ala, Asp, Gly, His, Ile, Lys, Leu, Met, Asn, Pro, Arg, Ser, Thr, Val, Trp or Tyr; the amino acid at position 775 is Val, Ala, Cys, Asp, Glu, Gly, His, Ile, Asn, Pro, Gln, Arg, Ser, Thr or Tyr; the amino acid at position 776 is Leu, Ala, Cys, Asp, Glu, Phe, Gly, His, Ile, Lys, Asn, Pro, Gln, Arg, Ser, Thr, Val or Tyr; the amino acid at position 777 is Pro, Ala, Cys, Asp, Glu, Phe, Gly, His, Lys, Leu, Met, Asn, Gln, Ser, Thr, Val, Trp or Tyr; the amino acid at position 778 is Phe, Ala, His, Ile, Leu, Met, Asn, Gln, Ser, Val, Trp or Tyr; the amino acid at position 779 is Gln, Ala, Cys, Asp, Glu, Gly, His, Lys, Leu, Asn, Pro, Arg, Ser, Thr or Val; the amino acid at position 780 is Ala, Cys, Asn, Pro, Gln or Ser; the amino acid at position 781 is Ala, Cys, Asp, Glu, Phe, Gly, His, Ile, Asn, Gln, Arg, Ser, Thr, Val, Trp or Tyr; the amino acid at position 782 is Ala, Cys, Asp, Glu, Phe, Gly, His, Ile, Lys, Met, Pro, Gln, Arg, Ser, Thr, Val, Trp or Tyr; the amino acid at position 783 is Pro, Ala, Cys, Asp, Glu, Gly, His, Asn, Gln, Arg, Ser, Thr or Val; the amino acid at position 784 is Leu, Ala, Glu, Phe, His, Ile, Lys, Met, Asn, Pro, Gln, Ser, Thr, Val or Trp; the amino acid at position 785 is Asn, Ala, Cys, Glu, Phe, Gly, His, Ile, Lys, Leu, Met, Gln, Arg, Ser, Thr, Val, Trp or Tyr; the amino acid at position 786 is Tyr, Phe, Ile, Leu or Trp; the amino acid at position 787 is His, Asn or Gln; the amino acid at position 788 is Tyr or Met; the amino acid at position 789 is Ala, Lys or Arg; the amino acid at position 790 is Tyr or Thr; the amino acid at position 791 is Arg, Lys, Gly or Ala; the amino acid at position 792 is Leu, Ile, Val, Thr or Ser; the amino acid at position 796 is Asp or Glu; the amino acid at position 797 is Ser, Thr or Ala the amino acid at position 802 is Glu, Lys, Asp, Asn or Gln; the amino acid at position 806 is Gln, Asp, Glu, Asn or His; the amino acid at position 810 is Lys, Arg or Thr; the amino acid at position 819 is Arg, Lys or His; the amino acid at position 829 is Lys, Ser, Ala or Pro; the amino acid at position 832 is Ala, Lys, Arg, Asp or Glu; the amino acid at position 833 is Gly, Ala, Asp or Glu; the amino acid at position 842 is Leu, Ile, Val or Pro; the amino acid at position 847 is Gln, Asn, Asp or Glu; the amino acid at position 848 is Ile, Leu or Val; the amino acid at position 849 is Val, Leu, Ile, Gly or Ala; the amino acid at position 855 is Thr, Ser or Met; the amino acid at position 860 is Ile, Leu or Val; and the amino acid at position 864 is His, Asn or Gln.

In some embodiments the nucleic acid molecule encoding the PtIP-83 polypeptide is derived from a fern species in the Division *Pteridophyta*. In some embodiments the PtIP-83 polypeptide is derived from a fern species in the Class Psilotopsida. In some embodiments the PtIP-83 polypeptide is derived from a fern species in the Class Psilotopsida, Order Psilotales. In some embodiments the PtIP-83 polypeptide is derived from a fern species in the Class Psilotopsida, Order Ophioglossales. In some embodiments the PtIP-83 polypeptide is derived from a fern species in the Class Psilotopsida, Order Ophioglossales, Family Psilotaceae. In some embodiments the PtIP-83 polypeptide is derived from a fern species in the Class Psilotopsida, Order Ophioglossales Family Ophioglossaceae. In some embodiments the PtIP-83 polypeptide is derived from a fern species in the Genus *Ophioglossum* L., *Botrychium, Botrypus, Helminthostachys, Ophioderma, Cheiroglossa, Sceptridium* or *Mankyua*. In some embodiments the PtIP-83 polypeptide is derived from a species in the Class Polypodiopsida/Pteridopsida. In some embodiments the PtIP-83 polypeptide is derived from a fern species in the Order Osmundales (royal ferns); Family Osmundaceae. In some embodiments the PtIP-83 polypeptide is derived from a fern species in the Order Hymenophyllales; Family Hymenophyllaceae. In some embodiments the PtIP-83 polypeptide is derived from a fern species in the Order Gleicheniales; Family Gleicheniaceae, Family Dipteridaceae or Family Matoniaceae. In some embodiments the PtIP-83 polypeptide is derived from a fern species in the Order Schizaeales; Family Lygodiaceae, Family Anemiaceae or Family Schizaeaceae. In some embodiments the PtIP-83 polypeptide is derived from a fern species in the Order Schizaeales; Family Schizaeaceae, Genus *Lygodium* selected from but not limited to *Lygodium articulatum, Lygodium circinatum, Lygodium conforme, Lygodium cubense, Lygodium digitatum, Lygodium flexuosum, Lygodium heterodoxum, Lygodium japonicum, Lygodium kerstenii, Lygodium lanceolatum, Lygodium longifolium, Lygodium merrilii, Lygodium micans, Lygodium microphyllum, Lygodium microstachyum, Lygodium oligostachyum, Lygodium palmatum, Lygodium polystachyum, Lygodium radiatum, Lygodium reticulatum, Lygodium salicifolium, Lygodium scandens, Lygodium smithianum, Lygodium subareolatum, Lygodium trifurcatum, Lygodium venustum, Lygodium versteeghii, Lygodium volubile,* and *Lygodium yunnanense*.

In some embodiments the PtIP-83 polypeptide is derived from a fern species in the Order Salviniales; Family Marsileaceae or Family Salviniaceae. In some embodiments the PtIP-83 polypeptide is derived from a fern species in the Order Cyatheales; Family Thyrsopteridaceae, Family Loxsomataceae, Family Culcitaceae, Family Plagiogyriaceae, Family Cibotiaceae, Family Cyatheaceae, Family Dicksoniaceae or Family Metaxyaceae.

In some embodiments the PtIP-83 polypeptide is derived from a fern species in the Order Polypodiales; Family Lindsaeaceae, Family Saccolomataceae, Family Cystodiaceae, Family Dennstaedtiaceae, Family Pteridaceae, Family Aspleniaceae, Family Thelypteridaceae, Family Woodsiaceae, Family Onocleaceae, Family Blechnaceae, Family Dryopteridaceae, Family Lomariopsidaceae, Family Tectariaceae, Family Oleandraceae, Family Davalliaceae or Family Polypodiaceae.

In some embodiments the PtIP-83 polypeptide is derived from a fern species in the Order Polypodiales, Family Pteridaceae, Genus *Adiantaceae* selected from but not limited to *Adiantum aethiopicum, Adiantum aleuticum, Adiantum bonatianum, Adiantum cajennense, Adiantum capillus-junonis, Adiantum capillus-veneris, Adiantum caudatum, Adiantum chienii, Adiantum chilense, Adiantum cuneatum, Adiantum cunninghamii, Adiantum davidii, Adiantum diaphanum, Adiantum edentulum, Adiantum edgeworthii, Adiantum excisum, Adiantum fengianum, Adiantum fimbriatum, Adiantum flabellulatum, Adiantum formosanum, Adiantum formosum, Adiantum fulvum, Adiantum gravesii, Adiantum hispidulum, Adiantum induratum, Adiantum jordanii, Adiantum juxtapositum, Adiantum latifolium, Adiantum leveillei, Adiantum lianxianense, Adiantum malesianum, Adiantum mariesii, Adiantum monochlamys, Adiantum myriosorum, Adiantum obliquum, Adiantum ogasawarense,*

*Adiantum pedatum, Adiantum pentadactylon, Adiantum peruvianum, Adiantum philippense, Adiantum princeps, Adiantum pubescens, Adiantum raddianum, Adiantum reniforme, Adiantum roborowskii, Adiantum serratodentatum, Adiantum sinicum, Adiantum soboliferum, Adiantum subcordatum, Adiantum tenerum, Adiantum terminatum, Adiantum tetraphyllum, Adiantum trapeziforme, Adiantum venustum, Adiantum viridescens,* and *Adiantum viridimontanum.*

In some embodiments the PtIP-83 polypeptide is derived from a fern species in the Order Polypodiales, Family Aspleniaceae, Genus *Asplenium.*

In some embodiments the PtIP-83 polypeptide is derived from a fern species in the Order Polypodiales, Family Aspleniaceae, Genus *Aspleniuml* selected from but not limited to *Asplenium adiantum, Asplenium adulterinum, Asplenium aequibasis, Asplenium aethiopicum, Asplenium africanum, Asplenium×alternifolium, Asplenium angustum, Asplenium antiquum, Asplenium ascensionis, Asplenium attenuatum, Asplenium aureum, Asplenium auritum, Asplenium australasicum, Asplenium azoricum, Asplenium bifrons, Asplenium billottii, Asplenium bipinnatifidum, Asplenium brachycarpum, Asplenium bradleyi, Asplenium bulbiferum, Asplenium caudatum, Asplenium ceterach, Asplenium compressum, Asplenium congestum, Asplenium corderoanum, Asplenium crinicaule, Asplenium cristatum, Asplenium cuneifolium, Asplenium cymbifolium, Asplenium daghestanicum, Asplenium dalhousiae, Asplenium dareoides, Asplenium daucifolium, Asplenium difforme, Asplenium fissum, Asplenium dimorphum, Asplenium divaricatum, Asplenium dregeanum, Asplenium×ebenoides, Asplenium ecuadorense, Asplenium feei Kunze, Asplenium fissum, Asplenium flabellifolium, Asplenium flaccidum, Asplenium fontanum, Asplenium forisiense, Asplenium formosum, Asplenium gemmiferum, Asplenium×germanicum, Asplenium gueinzii, Asplenium goudeyi, Asplenium hemionitis, Asplenium hermannii-christii, Asplenium hookerianum, Asplenium hybridum, Asplenium incisum, Asplenium×jacksonii, Asplenium×kenzoi, Asplenium laciniatum, Asplenium lamprophyllum, Asplenium laserpitiifolium, Asplenium lepidum, Asplenium listeri, Asplenium longissimum, Asplenium lucidum, Asplenium lunulatum, Asplenium lyallii, Asplenium macedonicum, Asplenium majoricum, Asplenium marinum, Asplenium×microdon, Asplenium milnei* Carruth, *Asplenium montanum, Asplenium musifolium, Asplenium nidus, Asplenium normale, Asplenium obliquum, Asplenium oblongifolium, Asplenium obovatum, Asplenium obtusatum, Asplenium oligolepidum, Asplenium oligophlebium, Asplenium onopteris, Asplenium pacificum, Asplenium paleaceum, Asplenium palmeri, Asplenium petrarchae, Asplenium pinnatifidum, Asplenium planicaule, Asplenium platybasis, Asplenium platyneuron, Asplenium polyodon, Asplenium praemorsum, Asplenium prolongatum, Asplenium pteridoides, Asplenium resiliens, Asplenium rhizophyllum, Asplenium richardii, Asplenium ruprechtii, Asplenium ruta-muraria, Asplenium rustifolium, Asplenium sagittatum, Asplenium sandersonii, Asplenium×sarniense, Asplenium schizotrichum, Asplenium schweinfurthii, Asplenium scleroprium, Asplenium scolopendrium* (syn. *Phyllitis scolopendrium), Asplenium seelosii, Asplenium septentrionale, Asplenium septentrionale×trichomanes, Asplenium serra, Asplenium serratum, Asplenium sessilifolium, Asplenium shuttleworthianum, Asplenium simplicifrons, Asplenium splendens, Asplenium surrogatum, Asplenium tenerum, Asplenium terrestre, Asplenium theciferum, Asplenium thunbergii, Asplenium trichomanes, Asplenium tutwilerae, Asplenium vespertinum, Asplenium vieillardii, Asplenium virens, Asplenium viride, Asplenium vittiforme,* and *Asplenium viviparum.*

In some embodiments the PtIP-83 polypeptide is derived from a fern species in the Order Polypodiales, Family Blechnaceae, Genus *Blecnum.*

In some embodiments the PtIP-83 polypeptide is derived from a fern species in the Order Polypodiales, Family Dryopteridaceae Genus *Acrophorus,* Genus *Acrorumohra,* Genus *Anapausia,* Genus *Arachniodes,* Genus *Bolbitis,* Genus *Ctenitis,* Genus *Cyclodium,* Genus *Cyrtogonellum,* Genus *Cyrtomidictyum,* Genus *Cyrtomium,* Genus *Diacalpe,* Genus *Didymochlaena,* Genus *Dryopsis,* Genus *Dryopteris,* Genus *Elaphoglossum,* Genus *Hypodematium,* Genus *Lastreopsis,* Genus *Leptorumohra,* Genus *Leucostegia,* Genus *Lithostegia,* Genus *Lomagramma,* Genus *Maxonia,* Genus *Megalastrum,* Genus *Olfersia,* Genus *Peranema,* Genus *Phanerophlebia,* Genus *Phanerophlebiopsis,* Genus *Polybotrya,* Genus *Polystichopsis,* Genus *Polystichum,* Genus *Rumohra,* Genus *Sorolepidium,* Genus *Stigmatopteris* or Genus *Teratophyllum.*

In some embodiments the PtIP-83 polypeptide is derived from a fern species in the Order Polypodiales, Family Dryopteridaceae, Genus *Polystichum.* In some embodiments the nucleic acid molecule encoding the PtIP-83 polypeptide is derived from a fern species in the Order Polypodiales, Family Dryopteridaceae, Genus *Polystichum* selected from but not limited to *Polystichum acanthophyllum, Polystichum acrostichoides, Polystichum aculeatum, Polystichum acutidens, Polystichum acutipinnulum, Polystichum alcicorne, Polystichum aleuticum, Polystichum andersonii, Polystichum atkinsonii, Polystichum australiense, Polystichum bakerianum, Polystichum biaristatum, Polystichum bomiense, Polystichum bonseyi, Polystichum brachypterum, Polystichum braunii, Polystichum brachypterum, Polystichum calderonense, Polystichum californicum, Polystichum capillipes, Polystichum castaneum, Polystichum chilense, Polystichum christii Ching, Polystichum chunii Ching, Polystichum craspedosorum, Polystichum cyclolobum, Polystichum cystostegia, Polystichum deltodon, Polystichum dielsii, Polystichum discretum, Polystichum drepanum, Polystichum dudleyi, Polystichum duthiei, Polystichum echinatum, Polystichum erosum, Polystichum excellens, Polystichum eximium, Polystichum falcatipinnum, Polystichum falcinellum, Polystichum fallax, Polystichum formosanum, Polystichum gongboense, Polystichum grandifrons, Polystichum gymnocarpium, Polystichum haleakalense, Polystichum hancockii, Polystichum hecatopteron, Polystichum herbaceum, Polystichum imbricans, Polystichum incongruum, Polystichum kruckebergii, Polystichum kwakiutlii, Polystichum lachenense, Polystichum lanceolatum, Polystichum lemmonii, Polystichum lentum, Polystichum lonchitis, Polystichum longidens, Polystichum longipaleatum, Polystichum longipes, Polystichum luctuosum, Polystichum macleae, Polystichum macrochlaenum, Polystichum makinoi, Polystichum martini, Polystichum mayebarae, Polystichum mediocre, Polystichum medogense, Polystichum microchlamys, Polystichum mohrioides, Polystichum mollissimum, Polystichum monticola, Polystichum moorei, Polystichum morii, Polystichum moupinense, Polystichum muricatum, Polystichum nakenense, Polystichum neolobatum, Polystichum nepalense, Polystichum ningshenense, Polystichum obliquum, Polystichum omeiense, Polystichum ordinatum, Polystichum orientalitibeticum, Polystichum paramoupinense, Polystichum parvipinnulum, Polystichum piceopaleaceum, Polystichum polyblepharum, Polystichum prescottianum, Polystichum prionolepis, Polystichum pro-* liferum, *Polystichum pseudocastaneum*¹, *Polystichum pseudomakinoi*, *Polystichum punctiferum*, *Polystichum pungens*, *Polystichum qamdoense*, *Polystichum retrosopaleaceum*, *Polystichum rhombiforme*, *Polystichum rhomboidea*, *Polystichum richardii*, *Polystichum rigens*, *Polystichum rotundilobum*, *Polystichum scopulinum*, *Polystichum semifertile*, *Polystichum setiferum*, *Polystichum setigerum*, *Polystichum shensiense*, *Polystichum silvaticum*, *Polystichum simplicipinnum*, *Polystichum sinense*, *Polystichum squarrosum*, *Polystichum stenophyllum*, *Polystichum stimulans*, *Polystichum submite*, *Polystichum tacticopterum*, *Polystichum thomsoni*, *Polystichum tibeticum*, *Polystichum transvaalense*, *Polystichum tripteron*, *Polystichum tsus-simense*, *Polystichum vestitum*, *Polystichum wattii*, *Polystichum whiteleggei*, *Polystichum xiphophyllum*, *Polystichum yadongense*, and *Polystichum yunnanense*.

In some embodiments the PtIP-83 polypeptide is derived from a fern species in the Order Polypodiales, Family Dryopteridaceae, Genus *Rumohra*. In some embodiments the nucleic acid molecule encoding the PtIP-83 polypeptide is derived from a fern species in the Order Polypodiales, Family Dryopteridaceae, Genus *Rumohra* selected from but not limited to *Rumohra adiantiformis*, *Rumohra aristata*, *Rumohra bartonae*, *Rumohra berteroana*, *Rumohra capuronii*, *Rumohra glandulosa*, *Rumohra humbertii*, *Rumohra linearisquamosa*, *Rumohra lokohensis*, *Rumohra madagascarica*, and *Rumohra quadrangularis*.

In some embodiments the PtIP-83 polypeptide is derived from a fern species in the Order Polypodiales, Family Lomariopsidaceae, Genus *Nephrolepis*.

In some embodiments the PtIP-83 polypeptide is derived from a fern species in the Order Polypodiales, Family Polypodiaceae, Genus *Campyloneurum*, Genus *Drynaria*, Genus *Lepisorus*, Genus *Microgramma*, Genus *Microsorum*, Genus *Neurodium*, Genus *Niphidium*, Genus *Pecluma* M.G., Genus *Phlebodium*, Genus *Phymatosorus*, Genus *Platycerium*, Genus *Pleopeltis*, Genus *Polypodium*.

In some embodiments the PtIP-83 polypeptide is derived from a fern species in the Order Polypodiales, Family Polypodiaceae, Genus *Microsorum*.

In some embodiments the PtIP-83 polypeptide is derived from a fern species in the Order Polypodiales, Family Polypodiaceae, Genus *Microsorum* selected from but not limited to *Microsorum alatum*, *Microsorum angustifolium*, *Microsorum aurantiacum*, *Microsorum australiense*, *Microsorum baithoense*, *Microsorum basicordatum*, *Microsorum biseriatum*, *Microsorum brassii*, *Microsorum buergerianum*, *Microsorum chapaense*, *Microsorum cinctum*, *Microsorum commutatum*, *Microsorum congregatifolium*, *Microsorum cuneatum*, *Microsorum cuspidatum*, *Microsorum dengii*, *Microsorum egregium*, *Microsorum emeiensis*, *Microsorum ensatum*, *Microsorum ensiforme*, *Microsorum excelsum*, *Microsorum fortunei*, *Microsorum griseorhizoma*, *Microsorum grossum*, *Microsorum hemionitideum*, *Microsorum henryi*, *Microsorum heterocarpum*, *Microsorum heterolobum*, *Microsorum howense*, *Microsorum insigne*, *Microsorum intermedium*, *Microsorum kongtingense*, *Microsorum krayanense*, *Microsorum lanceolatum*, *Microsorum lancifolium*, *Microsorum lastii*, *Microsorum latilobatum*, *Microsorum leandrianum*, *Microsorum lineare*, *Microsorum linguiforme*, *Microsorum longissimum*, *Microsorum longshengense*, *Microsorum maculosum*, *Microsorum maximum*, *Microsorum membranaceum*, *Microsorum membranifolium*, *Microsorum microsorioides*, *Microsorum minor*, *Microsorum monstrosum*, *Microsorum muliense*, *Microsorum mutense*, *Microsorum nanchuanense*, *Microsorum ningpoense*, *Microsorum normale*, *Microsorum novae-zealandiae*, *Microsorum ovalifolium*, *Microsorum ovatum*, *Microsorum palmatopedatum*, *Microsorum pappei*, *Microsorum papuanum*, *Microsorum parksii*, *Microsorum pentaphyllum*, *Microsorum piliferum*, *Microsorum pitcairnense*, *Microsorum powellii*, *Microsorum pteropodum*, *Microsorum pteropus*, *Microsorum punctatum*, *Microsorum pustulatum*, *Microsorum rampans*, *Microsorum revolutum*, *Microsorum rubidum*, *Microsorum samarense*, *Microsorum sapaense*, *Microsorum sarawakense*, *Microsorum scandens*, *Microsorum scolopendria*, *Microsorum sibomense*, *Microsorum sinense*, *Microsorum sopuense*, *Microsorum spectrum*, *Microsorum steerei*, *Microsorum subhemionitideum*, *Microsorum submarginale*, *Microsorum subnudum*, *Microsorum superficiale*, *Microsorum takhtajanii*, *Microsorum tenuipes*, *Microsorum tibeticum*, *Microsorum triglossum*, *Microsorum truncatum*, *Microsorum tsaii*, *Microsorum varians*, *Microsorum venosum*, *Microsorum vieillardii*, *Microsorum*×*inaequibasis*, *Microsorum yiliangensis*, and *Microsorum zippelii*.

In some embodiments the PtIP-83 polypeptide is derived from a fern species in the Order Polypodiales, Family Polypodiaceae, Genus *Polypodium* L.

In some embodiments the PtIP-83 polypeptide is derived from a fern species in the Order Polypodiales, Family Polypodiaceae, Genus *Polypodium* L. selected from but not limited to *Polypodium absidatum*, *Polypodium acutifolium*, *Polypodium adiantiforme*, *Polypodium aequale*, *Polypodium affine*, *Polypodium albidopaleatum*, *Polypodium alcicorne*, *Polypodium alfarii*, *Polypodium alfredii*, *Polypodium alfredii* var. *curtii*, *Polypodium allosuroides*, *Polypodium alsophilicola*, *Polypodium amamianum*, *Polypodium amoenum*, *Polypodium amorphum*, *Polypodium anetioides*, *Polypodium anfractuosum*, *Polypodium anguinum*, *Polypodium angustifolium* f. *remotifolia*, *Polypodium angustifolium* var. *amphostenon*, *Polypodium angustifolium* var. *heterolepis*, *Polypodium angustifolium* var. *monstrosa*, *Polypodium angustipaleatum*, *Polypodium angustissimum*, *Polypodium anisomeron* var. *pectinatum*, *Polypodium antioquianum*, *Polypodium aoristisorum*, *Polypodium apagolepis*, *Polypodium apicidens*, *Polypodium apiculatum*, *Polypodium apoense*, *Polypodium appalachianum*, *Polypodium appressum*, *Polypodium arenarium*, *Polypodium argentinum*, *Polypodium argutum*, *Polypodium armatum*, *Polypodium aromaticum*, *Polypodium aspersum*, *Polypodium assurgens*, *Polypodium atrum*, *Polypodium auriculatum*, *Polypodium balaonense*, *Polypodium balliviani*, *Polypodium bamleri*, *Polypodium bangii*, *Polypodium bartlettii*, *Polypodium basale*, *Polypodium bernoullii*, *Polypodium biauritum*, *Polypodium bifrons*, *Polypodium blepharodes*, *Polypodium bolivari*, *Polypodium bolivianum*, *Polypodium bolobense*, *Polypodium bombycinum*, *Polypodium bombycinum* var. *insularum*, *Polypodium bradeorum*, *Polypodium bryophilum*, *Polypodium bryopodum*, *Polypodium buchtienii*, *Polypodium buesii*, *Polypodium bulbotrichum*, *Polypodium caceresii*, *Polypodium californicum* f. *brauscombii*, *Polypodium californicum* f. *parsonsiae*, *Polypodium californicum*, *Polypodium calophlebium*, *Polypodium calvum*, *Polypodium camptophyllarium* var. *abbreviatum*, *Polypodium capitellatum*, *Polypodium carpinterae*, *Polypodium chachapoyense*, *Polypodium chartaceum*, *Polypodium chimantense*, *Polypodium chiricanum*, *Polypodium choquetangense*, *Polypodium christensenii*, *Polypodium christii*, *Polypodium chrysotrichum*, *Polypodium ciliolepis*, *Polypodium cinerascens*, *Polypodium collinsii*, *Polypodium colysoides*, *Polypodium confluens*, *Polypodium conforme*, *Polypodium confusum*, *Polypodium congregatifolium*, *Polypodium connellii*, *Polypodium consimile* var. *bourgaeanum*, *Polypo-* dium consimile var. minor, Polypodium conterminans, Polypodium contiguum, Polypodium cookii, Polypodium coriaceum, Polypodium coronans, Polypodium costaricense, Polypodium costatum, Polypodium crassifolium f. angustissimum, Polypodium crassifolium var. longipes, Polypodium crassulum, Polypodium craterisorum, Polypodium cryptum, Polypodium crystalloneuron, Polypodium cucullatum var. planum, Polypodium cuencanum, Polypodium cumingianum, Polypodium cupreolepis, Polypodium curranii, Polypodium curvans, Polypodium cyathicola, Polypodium cyathisorum, Polypodium cyclocolpon, Polypodium daguense, Polypodium damunense, Polypodium dareiformioides, Polypodium dasypleura, Polypodium decipiens, Polypodium decorum, Polypodium delicatulum, Polypodium deltoideum, Polypodium demeranum, Polypodium denticulatum, Polypodium diaphanum, Polypodium dilatatum, Polypodium dispersum, Polypodium dissectum, Polypodium dissimulans, Polypodium dolichosorum, Polypodium dolorense, Polypodium donnell-smithii, Polypodium drymoglossoides, Polypodium ebeninum, Polypodium eggersii, Polypodium elmeri, Polypodium elongatum, Polypodium enterosoroides, Polypodium erubescens, Polypodium erythrolepis, Polypodium erythrotrichum, Polypodium eurybasis, Polypodium eurybasis var. villosum, Polypodium exornans, Polypodium falcoideum, Polypodium fallacissimum, Polypodium farinosum, Polypodium faucium, Polypodium feei, Polypodium ferrugineum, Polypodium feuillei, Polypodium firmulum, Polypodium firmum, Polypodium flaccidum, Polypodium flagellare, Polypodium flexuosum, Polypodium flexuosum var. ekmanii, Polypodium forbesii, Polypodium formosanum, Polypodium fraxinifolium subsp. articulatum, Polypodium fraxinifolium subsp. luridum, Polypodium fructuosum, Polypodium fucoides, Polypodium fulvescens, Polypodium galeottii, Polypodium glaucum, Polypodium glycyrrhiza, Polypodium gracillimum, Polypodium gramineum, Polypodium grandifolium, Polypodium gratum, Polypodium graveolens, Polypodium griseo-nigrum, Polypodium griseum, Polypodium guttatum, Polypodium haalilioanum, Polypodium hammatisorum, Polypodium hancockii, Polypodium haplophlebicum, Polypodium harrisii, Polypodium hastatum var. simplex, Polypodium hawaiiense, Polypodium heanophyllum, Polypodium helleri, Polypodium hemionitidium, Polypodium henryi, Polypodium herzogii, Polypodium hesperium, Polypodium hessii, Polypodium hombersleyi, Polypodium hostmannii, Polypodium humile, Polypodium hyalinum, Polypodium iboense, Polypodium induens var. subdentatum, Polypodium insidiosum, Polypodium insigne, Polypodium intermedium subsp. masafueranum var. obtuseserratum, Polypodium intramarginale, Polypodium involutum, Polypodium itatiayense, Polypodium javanicum, Polypodium juglandifolium, Polypodium kaniense, Polypodium knowltoniorum, Polypodium kyimbilense, Polypodium l'herminieri var. costaricense, Polypodium lachniferum f. incurvata, Polypodium lachniferum var. glabrescens, Polypodium lachnopus, Polypodium lanceolatum var. complanatum, Polypodium lanceolatum var. trichophorum, Polypodium latevagans, Polypodium laxifrons, Polypodium laxifrons var. lividum, Polypodium lehmannianum, Polypodium leiorhizum, Polypodium leptopodon, Polypodium leuconeuron var. angustifolia, Polypodium leuconeuron var. latifolium, Polypodium leucosticta, Polypodium limulum, Polypodium lindigii, Polypodium lineatum, Polypodium lomarioides, Polypodium longifrons, Polypodium loretense, Polypodium loriceum var. umbraticum, Polypodium loriforme, Polypodium loxogramme f. gigas, Polypodium ludens, Polypodium luzonicum, Polypodium lycopodioides f. obtusum, Polypodium lycopodioides L., Polypodium macrolepis, Polypodium macrophyllum, Polypodium macrosorum, Polypodium macrosphaerum, Polypodium maculosum, Polypodium madrense, Polypodium manmeiense, Polypodium margaritiferum, Polypodium maritimum, Polypodium martensii, Polypodium mayoris, Polypodium megalolepis, Polypodium melanotrichum, Polypodium menisciifolium var. pubescens, Polypodium meniscioides, Polypodium merrillii, Polypodium mettenii, Polypodium mexiae, Polypodium microsorum, Polypodium militare, Polypodium minimum, Polypodium minusculum, Polypodium mixtum, Polypodium mollendense, Polypodium mollissimum, Polypodium moniliforme var. minus, Polypodium monoides, Polypodium monticola, Polypodium montigenum, Polypodium moritzianum, Polypodium moultonii, Polypodium multicaudatum, Polypodium multilineatum, Polypodium multisorum, Polypodium munchii, Polypodium muscoides, Polypodium myriolepis, Polypodium myriophyllum, Polypodium myriotrichum, Polypodium nematorhizon, Polypodium nemorale, Polypodium nesioticum, Polypodium nigrescentium, Polypodium nigripes, Polypodium nigrocinctum, Polypodium nimbatum, Polypodium nitidissimum, Polypodium nitidissimum var. latior, Polypodium nubrigenum, Polypodium oligolepis, Polypodium oligosorum, Polypodium oligosorum, Polypodium olivaceum, Polypodium olivaceum var. elatum, Polypodium oodes, Polypodium oosphaerum, Polypodium oreophilum, Polypodium ornatissimum, Polypodium ornatum, Polypodium ovatum, Polypodium oxylobum, Polypodium oxypholis, Polypodium pakkaense, Polypodium pallidum, Polypodium palmatopedatum, Polypodium palmeri, Polypodium panamense, Polypodium parvum, Polypodium patagonicum, Polypodium paucisorum, Polypodium pavonianum, Polypodium pectinatum var. caliense, Polypodium pectinatum var. hispidum, Polypodium pellucidum, Polypodium pendulum var. boliviense, Polypodium percrassum, Polypodium perpusillum, Polypodium peruvianum var. subgibbosum, Polypodium phyllitidis var. elongatum, Polypodium pichinchense, Polypodium pilosissimum, Polypodium pilosissimum var. glabriusculum, Polypodium pilossimum var. tunguraquensis, Polypodium pityrolepis, Polypodium platyphyllum, Polypodium playfairii, Polypodium plebeium var. cooperi, Polypodium plectolepidioides, Polypodium pleolepis, Polypodium plesiosorum var. i, Polypodium podobasis, Polypodium podocarpum, Polypodium poloense, Polypodium polydatylon, Polypodium polypodioides var. aciculare, Polypodium polypodioides var. michauxianum, Polypodium praetermissum, Polypodium preslianum var. immersum, Polypodium procerum, Polypodium procerum, Polypodium productum, Polypodium productum, Polypodium prolongilobum, Polypodium propinguum, Polypodium proteus, Polypodium pruinatum, Polypodium pseudocapillare, Polypodium pseudofraternum, Polypodium pseudonutans, Polypodium pseudoserratum, Polypodium pulcherrimum, Polypodium pulogense, Polypodium pungens, Polypodium purpusii, Polypodium radicale, Polypodium randallii, Polypodium ratiborii, Polypodium reclinatum, Polypodium recreense, Polypodium repens var. abruptum, Polypodium revolvens, Polypodium rhachipterygium, Polypodium rhomboideum, Polypodium rigens, Polypodium robustum, Polypodium roraimense, Polypodium roraimense, Polypodium rosei, Polypodium rosenstockii, Polypodium rubidum, Polypodium rudimentum, Polypodium rusbyi, Polypodium sablanianum, Polypodium sarmentosum, Polypodium saxicola, Polypodium schenckii, Polypodium schlechteri, Polypodium scolopendria, Polypodium scolopendria, Polypodium scolopendrium, Polypodium scouleri, Polypodium scutulatum, Polypodium segregatum, Polypodium semihirsutum, Polypodium semihirsutum var. fuscosetosum, Polypodium senile var. minor, Polypodium sericeolanatum, Polypodium serraeforme, Polypodium serricula, Polypodium sesquipedala, Polypodium sessilifolium, Polypodium setosum var. calvum, Polypodium setulosum, Polypodium shaferi, Polypodium sibomense, Polypodium siccum, Polypodium simacense, Polypodium simulans, Polypodium singeri, Polypodium sinicum, Polypodium sintenisii, Polypodium skutchii, Polypodium sloanei, Polypodium sodiroi, Polypodium sordidulum, Polypodium sordidum, Polypodium sphaeropteroides, Polypodium sphenodes, Polypodium sprucei, Polypodium sprucei var. furcativenosa, Polypodium steirolepis, Polypodium stenobasis, Polypodium stenolepis, Polypodium stenopterum, Polypodium subcapillare, Polypodium subflabelliforme, Polypodium subhemionitidium, Polypodium subinaequale, Polypodium subintegrum, Polypodium subspathulatum, Polypodium subtile, Polypodium subvestitum, Polypodium subviride, Polypodium superficiale var. attenuatum, Polypodium superficiale var. chinensis, Polypodium sursumcurrens, Polypodium tablazianum, Polypodium taenifolium, Polypodium tamandarei, Polypodium tatei, Polypodium tenuiculum var. acrosora, Polypodium tenuiculum var. brasiliense, Polypodium tenuilore, Polypodium tenuinerve, Polypodium tepuiense, Polypodium teresae, Polypodium tetragonum var. incompletum, Polypodium thysanolepis var. bipinnatifidum, Polypodium thyssanolepis, var. thyssanolepis, Polypodium thyssanolepsi, Polypodium tobagense, Polypodium trichophyllum, Polypodium tridactylum, Polypodium tridentatum, Polypodium trifurcatum var. brevipes, Polypodium triglossum, Polypodium truncatulum, Polypodium truncicola var. major, Polypodium truncicola var. minor, Polypodium tuberosum, Polypodium tunguraguae, Polypodium turquinum, Polypodium turrialbae, Polypodium ursipes, Polypodium vagans, Polypodium valdealatum, Polypodium versteegii, Polypodium villagranii, Polypodium virginianum f. cambroideum, Polypodium virginianum f. peraferens, Polypodium vittarioides, Polypodium vulgare, Polypodium vulgare L., Polypodium vulgare subsp. oreophilum, Polypodium vulgare var. acuminatum, Polypodium vulpinum, Polypodium williamsii, Polypodium wobbense, Polypodium×fallacissimum-guttatum, Polypodium xantholepis, Polypodium xiphopteris, Polypodium yarumalense, Polypodium yungense, and Polypodium zosteriforme.

In some embodiments the PtIP-83 polypeptide is derived from a fern species in the Order Polypodiales, Family Polypodiaceae, Genus Platycerium.

In some embodiments the PtIP-83 polypeptide is derived from a species in the Division Lycophyta.

In some embodiments the PtIP-83 polypeptide is derived from a species in the Class Isoetopsida or Class Lycopodiopsida.

In some embodiments the PtIP-83 polypeptide is derived from a species in the Class Isoetopsida Order Selaginales. In some embodiments the PtIP-83 polypeptide is derived from a fern species in the Class Isoetopsida, Order Selaginales, Family Selaginellaceae. In some embodiments the PtIP-83 polypeptide is derived from a species in the Genus Selaginella. In some embodiments the PtIP-83 polypeptide is derived from a species in the Class Lycopodiopsida, Order Lycopodiales.

In some embodiments the PtIP-83 polypeptide is derived from a fern species in the Class Lycopodiopsida, Order Lycopodiales Family Lycopodiaceae or Family Huperziaceae.

In some embodiments the PtIP-83 polypeptide is derived from a species in the Genus Austrolycopodium, Dendrolycopodium, Diphasiastrum, Diphasium, Huperzia, Lateristachys, Lycopodiastrum, Lycopodiella, Lycopodium, Palhinhaea, Pseudodiphasium, Pseudolycopodiella, Pseudolycopodium or Spinulum.

In some embodiments the PtIP-83 polypeptide is derived from a species in the Genus Lycopodium.

In some embodiments the PtIP-83 polypeptide is derived from a species in the Genus Huperzia.

Phylogenetic, Sequence Motif, and Structural Analyses for Insecticidal Protein Families The sequence and structure analysis method employed is composed of four components: phylogenetic tree construction, protein sequence motifs finding, secondary structure prediction, and alignment of protein sequences and secondary structures. Details about each component are illustrated below.

Phylogenetic Tree Construction

The phylogenetic analysis was performed using the software MEGA5. Protein sequences were subjected to ClustalW version 2 analysis (Larkin M. A et al (2007) Bioinformatics 23(21): 2947-2948) for multiple sequence alignment. The evolutionary history was then inferred by the Maximum Likelihood method based on the JTT matrix-based model. The tree with the highest log likelihood was obtained, exported in Newick format, and further processed to extract the sequence IDs in the same order as they appeared in the tree. A few clades representing sub-families were manually identified for each insecticidal protein family.

Protein Sequence Motifs Finding

Protein sequences were re-ordered according to the phylogenetic tree built previously, and fed to the MOTIF analysis tool MEME (Multiple EM for MOTIF Elicitation) (Bailey T. L., and Elkan C., Proceedings of the Second International Conference on Intelligent Systems for Molecular Biology, pp. 28-36, AAAI Press, Menlo Park, Calif., 1994) for identification of key sequence motifs. MEME was setup as follows: Minimum number of sites 2, Minimum motif width 5, and Maximum number of motifs 30. Sequence motifs unique to each sub-family were identified by visual observation. The distribution of MOTIFs across the entire gene family could be visualized in HTML webpage. The MOTIFs are numbered relative to the ranking of the E-value for each MOTIF. The amino acid sequence MOTIFs identified for each of the PtIP-83 polypeptides and the residue ranges defining the MOTIFs relative to each of the corresponding sequence identifier (SEQ ID NO:) are shown in Table 2. FIG. 2 shows an alignment of the PtIP-83 polypeptides PtIP-83Aa (SEQ ID NO: 1), PtIP-83Ca (SEQ ID NO: 5), PtIP-83Cb (SEQ ID NO: 7), PtIP-83Cc (SEQ ID NO: 9), PtIP-83Cd (SEQ ID NO: 11), PtIP-83Ce (SEQ ID NO: 13), PtIP-83Cf (SEQ ID NO: 15), and PtIP-83Fa (SEQ ID NO: 3), and the location relative to PtIP-83Aa (SEQ ID NO: 1) of the amino acid sequence MOTIFs present in PtIP-83Aa (SEQ ID NO: 1).

Secondary Structure Prediction

PSIPRED, top ranked secondary structure prediction method (Jones D T. (1999) J. Mol. Biol. 292: 195-202), was installed in local Linux server, and used for protein secondary structure prediction. The tool provides accurate structure prediction using two feed-forward neural networks based on the PSI-BLAST output. The PSI-BLAST database was created by removing low-complexity, transmembrane, and coiled-coil regions in Uniref100. The PSIPRED results contain the PtIP-secondary structures (Alpha helix: H, Beta strand: E, and Coil: C) and the corresponding confidence scores for each amino acid in a given protein sequence. FIG.

2 shows the PtIP-83 polypeptide amino acid sequence alignments and the conserved secondary structural regions.

TABLE 2

| SEQ ID NO: | MOTIF 19 | MOTIF 7 | MOTIF 13 | MOTIF 20 | MOTIF 10 | MOTIF 18 |
|---|---|---|---|---|---|---|
| PtIP-83Aa | 1 | 4-17 | 21-64 | 71-100 | 102-120 | n.p. | n.p. |
| PtIP-83Ca | 5 | 1-14 | 17-60 | 68-97 | 98-116 | 122-171 | 173-208 |
| PtIP-83Cb | 7 | 1-14 | 17-60 | 69-98 | n.p. | 121-170 | n.p. |
| PtIP-83Cc | 9 | 1-14 | 17-60 | 68-97 | 98-116 | 122-171 | 173-208 |
| PtIP-83Cd | 11 | 1-14 | 17-60 | 68-97 | 98-116 | 122-171 | 173-208 |
| PtIP-83Ce | 13 | 1-14 | 17-60 | 68-97 | 98-116 | 121-170 | 173-208 |
| PtIP-83Cf | 15 | 1-14 | 21-64 | 68-97 | 98-116 | 122-171 | n.p. |
| PtIP-83Fa | 3 | 5-18 | 17-60 | 68-97 | n.p. | n.p. | n.p. |

| SEQ ID NO: | MOTIF 24 | MOTIF 14 | MOTIF 11 | MOTIF 22 | MOTIF 2 | MOTIF 8 |
|---|---|---|---|---|---|---|
| PtIP-83Aa | 1 | n.p. | 238-263 | n.p. | 313-326 | 327-376 | 376-425 |
| PtIP-83Ca | 5 | 211-220 | 221-246 | 248-297 | 298-311 | 312-361 | 362-411 |
| PtIP-83Cb | 7 | n.p. | 223-248 | 249-298 | 299-312 | 313-362 | 363-412 |
| PtIP-83Cc | 9 | 211-220 | 221-246 | 248-297 | 298-311 | 312-361 | 362-411 |
| PtIP-83Cd | 11 | 211-220 | 221-246 | 248-297 | 298-311 | 312-361 | 362-411 |
| PtIP-83Ce | 13 | 211-220 | 221-246 | 248-297 | 298-311 | 312-361 | 362-411 |
| PtIP-83Cf | 15 | 211-220 | 221-246 | 248-297 | 298-311 | 312-361 | 362-411 |
| PtIP-83Fa | 3 | 247-256 | 262-287 | n.p. | 329-342 | 344-393 | 394-443 |

| SEQ ID NO: | MOTIF 21 | MOTIF 15 | MOTIF 9 | MOTIF 1 | MOTIF 17 | MOTIF 6 |
|---|---|---|---|---|---|---|
| PtIP-83Aa | 1 | 508-521 | 428-453 | 455-504 | 523-572 | 576-594 | 596-645 |
| PtIP-83Ca | 5 | 493-506 | 413-438 | 441-490 | 508-557 | 561-579 | 581-630 |
| PtIP-83Cb | 7 | 494-507 | 414-439 | 442-491 | 509-558 | 562-580 | 582-631 |
| PtIP-83Cc | 9 | 493-506 | 413-438 | 441-490 | 508-557 | 561-579 | 581-630 |
| PtIP-83Cd | 11 | 493-506 | 413-438 | 441-490 | 508-557 | 561-579 | 581-630 |
| PtIP-83Ce | 13 | 493-506 | 413-438 | 441-490 | 508-557 | 561-579 | 581-630 |
| PtIP-83Cf | 15 | 493-506 | 413-438 | 441-490 | 508-557 | 561-579 | 581-630 |
| PtIP-83Fa | 3 | 525-538 | 445-470 | 473-522 | 540-589 | 593-611 | 613-662 |

| SEQ ID NO: | MOTIF 12 | MOTIF 4 | MOTIF 16 | MOTIF 5 | MOTIF 23 | MOTIF 3 |
|---|---|---|---|---|---|---|
| PtIP-83Aa | 1 | 648-683 | 684-719 | 723-741 | 746-795 | 798-807 | 809-858 |
| PtIP-83Ca | 5 | 634-669 | 670-705 | 708-726 | 732-781 | 784-793 | 795-844 |
| PtIP-83Cb | 7 | 635-670 | 671-706 | 709-727 | 731-780 | 783-792 | 794-843 |
| PtIP-83Cc | 9 | 634-669 | 670-705 | 708-726 | 730-779 | 782-791 | 793-842 |
| PtIP-83Cd | 11 | 634-669 | 670-705 | 708-726 | 730-779 | 782-791 | 793-842 |
| PtIP-83Ce | 13 | 634-669 | 670-705 | 708-726 | 730-779 | 782-791 | 793-842 |
| PtIP-83Cf | 15 | 634-669 | 670-705 | 708-726 | 731-780 | 783-792 | 794-843 |
| PtIP-83Fa | 3 | 667-702 | 703-738 | 740-758 | 763-812 | 815-824 | 826-875 | n.p. = not present

Alignment of Protein Sequences and Secondary Structures

A customized script was developed to generate gapped secondary structure alignment according to the multiple protein sequence alignment from step 1 for all proteins. All aligned protein sequences and structures were concatenated into a single FASTA file, and then imported into MEGA for visualization and identification of conserved structures.

In some embodiments a PtIP-83 polypeptide comprises an amino acid sequence MOTIF selected from: an amino acid sequence MOTIF 1 as represented by an amino acid sequence of the formula MP[DE]MPSEADWSIFVNE[IV]EAVAEGMPTEVSEVP[AV]WKAKCKN[MV]AAL-GREM[SC]I (SEQ ID NO: 646); an amino acid sequence MOTIF 2 as represented by an amino acid sequence of the formula PQLQYRMYG[NS]LI[KN]QMAQVAQNYDQ[ED]FKQ[FL]KLFI[IA]QNQI[LF]GSYLLQQN[KR]A F (SEQ ID NO: 647); an amino acid sequence MOTIF 3 as represented by an amino acid sequence of the formula NTFMQMTPFTRWRLRLSASASENA[EG]LAFPTATA[PL]DSTT[EQ][IV]VITFHVTAIR (SEQ ID NO: 648); an amino acid sequence MOTIF 4 as represented by an amino acid sequence of the formula [DN]FTSRHVVK[GD]IP-VSLLLDGEDWEFEIPVQ[AG]GMSSFP (SEQ ID NO: 649); an amino acid sequence MOTIF 5 as represented by an amino acid sequence of the formula IIHQP[SA]T[RQ][ST]G[IT]VYILLQGSTIFHDRRR[DE]EVMTFQAA[DA]PLN[FY][QH]YAYRLDT G (SEQ ID NO: 650); an amino acid sequence MOTIF 6 as represented by an amino acid sequence of the formula S[HQ]ADRLAAIQP[AV]DLTN[HY]LEMAT[HQ]MDMRTT[RS][MI]L[IL]GLLN[MI] LRIQNAALMY EY (SEQ ID NO: 651); an amino acid sequence MOTIF 7 as represented by an amino acid sequence of the formula [VL]DRVEFSEVMVIHRMYVRL[SA]DL[ND]VGEL[PE]GA[EG][RK]VKR[VL]YV[FL] ADWE (SEQ ID NO: 652); an amino acid sequence MOTIF 8 as represented by an amino acid sequence of the formula A[DE]RELQMESFHSAVISQRRQEL[ND]TA[IF]AKM[DE]R[LM]SLQMEEE[NS]RAMEQAQKE M (SEQ ID NO: 653); an amino acid sequence MOTIF 9 as represented by an amino acid sequence of the formula FVTAGATAPGA[AV]ASAGQAVSIAGQAAQ[AG]LRRWEILE[GQ] LEAVMEWAA[VI]K (SEQ ID NO: 654); an amino acid sequence MOTIF 10 as represented by an amino acid sequence of the formula DGMNWG[IT]YI[YH]GE[KE]V

[EQ]RSPLLPSNAILAVWADRC[TI]ITSARHNH[VF]NAPGR[IV]I (SEQ ID NO: 655); an amino acid sequence MOTIF 11 as represented by an amino acid sequence of the formula [KV][VK][CA]RPPSPDM[MV]SAVAEHAL-WLNDVLLQWQ[KN]ESQ[LM]QGT[AE]PYNECLAL LGR (SEQ ID NO: 656); an amino acid sequence MOTIF 12 as represented by an amino acid sequence of the formula PTELT[VA]WPLGMDTV[AG]NLLIAQENAAL[VL]GLIQLGPSS (SEQ ID NO: 657); an amino acid sequence MOTIF 13 as represented by an amino acid sequence of the formula RDQ[MT][HQ]MPGSVTVI[IV]LCRLLQFP[IT]DGSQA[TA]T (SEQ ID NO: 658); an amino acid sequence MOTIF 14 as represented by an amino acid sequence of the formula TSIPVEVVTDP[SN]ILLGMQTTV[LH]IAEL (SEQ ID NO: 659); an amino acid sequence MOTIF 15 as represented by an amino acid sequence of the formula EGLR[EQ]FQNRQVARA[VL]FAVLKAVA[MQ]I[AG] (SEQ ID NO: 660); an amino acid sequence MOTIF 16 as represented by an amino acid sequence of the formula W[TS]RVRIRHLEM[QH]F[AV]QEASG (SEQ ID NO: 661); an amino acid sequence MOTIF 17 as represented by an amino acid sequence of the formula QISELQY[ED]IWVQG[LM][ML]RDIA (SEQ ID NO: 662); an amino acid sequence MOTIF 18 as represented by an amino acid sequence of the formula TFTLGSGVTGITSMHGEPSLD-PWNGVSLDSASPTAF (SEQ ID NO: 663); an amino acid sequence MOTIF 19 as represented by an amino acid sequence of the formula MDYSTLYRDLNQIS (SEQ ID NO: 664); an amino acid sequence MOTIF 20 as represented by an amino acid sequence of the formula LRLPFM[QK]LHARVIEQN[VR]K[SE] (SEQ ID NO: 665); an amino acid sequence MOTIF 21 as represented by an amino acid sequence of the formula VDSLEQVG[QH][IL]V[GD]AP (SEQ ID NO: 666); an amino acid sequence MOTIF 22 as represented by an amino acid sequence of the formula [IV][EQ][CA]VMK[IM]GRF[VG][SL]W (SEQ ID NO: 667); an amino acid sequence MOTIF 23 as represented by an amino acid sequence of the formula TLTNEPSE[EQ]F (SEQ ID NO: 668); and an amino acid sequence MOTIF 24 as represented by an amino acid sequence of the formula LPRQSRNISF (SEQ ID NO: 669).

In some embodiments a PtIP-83 polypeptide comprises an amino acid sequence MOTIF selected from: an amino acid sequence MOTIF 1 having at least 90% sequence identity to the amino acid sequence as represented by the formula MP[DE]MPSEADWSIFVNE[IV]EAVAEGMPTEVSEVP[AV]WKAKCKN[MV]AALGREM[SC]I (SEQ ID NO: 646); an amino acid sequence MOTIF 2 having at least 90% sequence identity to the amino acid sequence as represented by the formula PQLQYRMYG[NS]LI[KN]QMAQVAQNYDQ[ED]FKQ[FL]KLFI[IA]QNQI[LF]GSYLLQQN[KR]A F (SEQ ID NO: 647); an amino acid sequence MOTIF 3 having at least 90% sequence identity to the amino acid sequence as represented by the formula NTFMQMTPFTRWRLRLSASASENA[EG]LAFPTATA[PL]DSTT[EQ][IV]VITFHVTAIR (SEQ ID NO: 648); an amino acid sequence MOTIF 4 having at least 90% sequence identity to the amino acid sequence as represented by the formula [DN]FTSRHVVK[GD]IPVSLLLDGED-WEFEIPVQ[AG]GMSSFP (SEQ ID NO: 649); an amino acid sequence MOTIF 5 having at least 90% sequence identity to the amino acid sequence as represented by the formula IIHQP[SA]T[RQ][ST]G[IT]VYILLQGSTIFH-DRRR[DE]EVMTFQAA[DA]PLN[FY][QH]YAYRLDT G (SEQ ID NO: 650); an amino acid sequence MOTIF 6 having at least 90% sequence identity to the amino acid sequence as represented by the formula S[HQ]ADRLAAI-QP[AV]DLTN[HY]LEMAT[HQ]MDMRTT[RS][MI]L[IL]GLLN[MI]LRIQNAALMY EY (SEQ ID NO: 651); an amino acid sequence MOTIF 7 having at least 90% sequence identity to the amino acid sequence as represented by the formula [VL]DRVEFSEVMVIHRMYVRL[SA]DL[ND]VGEL[PE]GA[EG][RK]VKR[VL]YV[FL]ADWE (SEQ ID NO: 652); an amino acid sequence MOTIF 8 having at least 90% sequence identity to the amino acid sequence as represented by the formula A[DE]RELQMES-FHSAVISQRRQEL[ND]TA[IF]AKM[DE]R[LM]SLQMEEE[NS]RAMEQAQKE M (SEQ ID NO: 653); an amino acid sequence MOTIF 9 having at least 90% sequence identity to the amino acid sequence as represented by the formula FVTAGATAPGA[AV]ASAGQAV-SIAGQAAQ[AG]LRRWEILE[GQ]LEAVMEWAA[VI]K (SEQ ID NO: 654); an amino acid sequence MOTIF 10 having at least 90% sequence identity to the amino acid sequence as represented by the formula DGMNWG[IT]YI[YH]GE[KE]V[EQ]RSPLLPSNAILAVWADRC[TI]IT-SARHNH[VF]NAPGR[IV]I (SEQ ID NO: 655); an amino acid sequence MOTIF 11 having at least 90% sequence identity to the amino acid sequence as represented by the formula [KV][VK][CA]RPPSPDM[MV]SAVAEHAL-WLNDVLLQWQ[KN]ESQ[LM]QGT[AE]PYNECLAL LGR (SEQ ID NO: 656); an amino acid sequence MOTIF 12 having at least 90% sequence identity to the amino acid sequence as represented by the formula PTELT[VA]WPL-GMDTV[AG]NLLIAQENAAL[VL]GLIQLGPSS (SEQ ID NO: 657); an amino acid sequence MOTIF 13 having at least 90% sequence identity to the amino acid sequence as represented by the formula RDQ[MT][HQ]MPGSVTVI[IV]LCRLLQFP[IT]DGSQA[TA]T (SEQ ID NO: 658); an amino acid sequence MOTIF 14 having at least 90% sequence identity to the amino acid sequence as represented by the formula TSIPVEWTDP[SN]ILLGMQTTV[LH]IAEL (SEQ ID NO: 659); an amino acid sequence MOTIF 15 having at least 90% sequence identity to the amino acid sequence as represented by the formula EGLR[EQ]FQN-RQVARA[VL]FAVLKAVA[MQ]I[AG] (SEQ ID NO: 660); an amino acid sequence MOTIF 16 having at least 90% sequence identity to the amino acid sequence as represented by the formula W[TS]RVRIRHLEM[QH]F[AV]QEASG (SEQ ID NO: 661); an amino acid sequence MOTIF 17 having at least 90% sequence identity to the amino acid sequence as represented by the formula QISELQY[ED]IWVQG[LM][ML]RDIA (SEQ ID NO: 662); an amino acid sequence MOTIF 18 having at least 90% sequence identity to the amino acid sequence as represented by the formula TFTLGSGVTGITSMHGEPSLDPWNGVSLDSASPTAF (SEQ ID NO: 663); an amino acid sequence MOTIF 19 having at least 90% sequence identity to the amino acid sequence as represented by the formula MDYSTLYRDLN-QIS (SEQ ID NO: 664); an amino acid sequence MOTIF 20 having at least 90% sequence identity to the amino acid sequence as represented by the formula LRLPFM[QK]LHARVIEQN[VR]K[SE] (SEQ ID NO: 665); an amino acid sequence MOTIF 21 having at least 90% sequence identity to the amino acid sequence as represented by the formula VDSLEQVG[QH][IL]V[GD]AP (SEQ ID NO: 666); an amino acid sequence MOTIF 22 having at least 90% sequence identity to the amino acid sequence as represented by the formula [IV][EQ][CA]VMK[IM]GRF[VG][SL]VV (SEQ ID NO: 667); an amino acid sequence MOTIF 23 having at least 90% sequence identity to the amino acid sequence as represented by the formula TLTNEPSE[EQ]F (SEQ ID NO: 668); and an amino acid sequence MOTIF 24 having at least 90% sequence identity to the amino acid sequence as represented by the formula LPRQSRNISF (SEQ ID NO: 669).

In some embodiments a PtIP-83 polypeptide comprises an amino acid sequence MOTIF selected from: an amino acid sequence MOTIF 1 as represented by an amino acid sequence of the formula MP[DE]MP[ST][ED]ADWSIFVNE[IVL]EAVAEGMPTEVSEVP[AV]W[KR]AKCKN[MV]AALGRE M[SC]I (SEQ ID NO: 670); an amino acid sequence MOTIF 2 as represented by an amino acid sequence of the formula PQLQYRMYG[NS]LI[KRN]QMAQVAQNYD[QR][ED]FK[QR][FL][KR]LFI[IAVL]QNQI[LF]GSYL L[QE]QN[KR]AF (SEQ ID NO: 671); an amino acid sequence MOTIF 3 as represented by an amino acid sequence of the formula N[TK]FMQMTPFT[RH]WRLRLSASA[SPKA]EN[AK][EG]LAFPTATA[PL]DSTT[EQ][IV][VA]ITF HVTAIR (SEQ ID NO: 672); an amino acid sequence MOTIF 4 as represented by an amino acid sequence of the formula [DN]FTSRHVVK[GD]IPV[SN]LLLDG[EG]DWEFEIPVQ[AG]GMSSFP (SEQ ID NO: 673); an amino acid sequence MOTIF 5 as represented by an amino acid sequence of the formula IIHQP[SA]T[RQ][ST]G[IT][VI]YILLQGST[IV]FHDRRR[DE][EQ]V[ML]T[FP]QAA[DAV]PLN[FY][QH]YAYRLDTG (SEQ ID NO: 674); an amino acid sequence MOTIF 6 as represented by an amino acid sequence of the formula S[HQ]ADRLAAIQP[AV][DN]LTN[HYF]LEMAT[HQ]MDMRTT[RS][MI]L[IL]GLLN[MI][LM]RIQN AAL[MR]YEY (SEQ ID NO: 675); an amino acid sequence MOTIF 7 as represented by an amino acid sequence of the formula [VL]D[RQ]VEFSEVMVIHRMYV[N]RL[SA]DL[ND]V[GA][EQ]L[PE]GA[EG][RK]VKR[VL]YV[FL]ADVVE (SEQ ID NO: 676); an amino acid sequence MOTIF 8 as represented by an amino acid sequence of the formula A[DE]RELQMESFH[SA]AVISQ[RK]R[QGE]EL[ND][TD][AT][IF]AKM[DE]R[LM]SLQMEEE[NS D][RG]AMEQA[QR]KEM (SEQ ID NO: 677); an amino acid sequence MOTIF 9 as represented by an amino acid sequence of the formula F[VL]TAGATAPGA[AV]ASAGQAV[SN]IAGQAAQ[AG]LRRVVEILE[GQ]LEAVMEVVAA[VI]K (SEQ ID NO: 678); an amino acid sequence MOTIF 10 as represented by an amino acid sequence of the formula D[GD][MA][NK]WG[IT]Y[IV][YH][GA]E[KE]V[EQ][RVL]SPL[LYF][PN][SNG][NW][ASP][IY]L[AG] V]V[WE]A[DQ]R[CS][TI]IT[SA]A[RFM]HN[HVT][VF][ND][AER]PG[RW][IV][IR] (SEQ ID NO: 679); an amino acid sequence MOTIF 11 as represented by an amino acid sequence of the formula [KV][VK][CA][RGC][PHY]PSP[DE][MIL][MV]SAV[AG][EV]HA[LI N]WL[NS][DK]VLL[QR]WQ[K N]ES[QH][LM]QGT[AE][PSA]YNECLALLGR (SEQ ID NO: 680); an amino acid sequence MOTIF 12 as represented by an amino acid sequence of the formula [PN]T[EQ]LT[VAT]WPL[GR]MDTV[AG][ND]LLI[AT][QH]E[NS]AAL[VLS]GL[ITMA]QLG[PQ][S P]S (SEQ ID NO: 681); an amino acid sequence MOTIF 13 as represented by an amino acid sequence of the formula [RLC][DLWK][QNPR][MTP][HQR][MIL]PGSVTVI[IV]LCRLLQFP[IT][DG]G[SR][QFR][AS][TAD][TW] (SEQ ID NO: 682); an amino acid sequence MOTIF 14 as represented by an amino acid sequence of the formula [TA][SGV][IL]PV[ED]WTDP[SN]IL[LM]GMQT[TS]V[LH]IAEL (SEQ ID NO: 683); an amino acid sequence MOTIF 15 as represented by an amino acid sequence of the formula EGLR[EQ]FQN[RE]QVA[RN]A[VL]FAVL[KS][AS]VA[MQ]I[AG] (SEQ ID NO: 684); an amino acid sequence MOTIF 16 as represented by an amino acid sequence of the formula W[TS]RVRIRHLEM[QH]F[AV][QK]E[AS][SM][GN] (SEQ ID NO: 685); an amino acid sequence MOTIF 17 as represented by an amino acid sequence of the formula Q[IM]S[EQ]LQY[ED]IWVQG[LM][ML]RD[IM]A (SEQ ID NO: 686); an amino acid sequence MOTIF 18 as represented by an amino acid sequence of the formula TFTLGSGVTGITSMHGEPSLDPWNGVSLDSASPTAF (SEQ ID NO: 663); an amino acid sequence MOTIF 19 as represented by an amino acid sequence of the formula [MLV]DY[SK][TSK]L[YF][RE]DLNQIS (SEQ ID NO: 687); an amino acid sequence MOTIF 20 as represented by an amino acid sequence of the formula L[RHQ]L[PT]FM[QK]LHA[RIT][VQL][IR]E[QER][NF][VR][KWS][SE] (SEQ ID NO: 688); an amino acid sequence MOTIF 21 as represented by an amino acid sequence of the formula V[DN][SA]L[ED]QV[GS][QH][IL]V[GD]AP (SEQ ID NO: 689); an amino acid sequence MOTIF 22 as represented by an amino acid sequence of the formula [IV][EQH][CAS][VA][MI]K[IM][GV][RP][FI][VG][SL]W (SEQ ID NO: 690); an amino acid sequence MOTIF 23 as represented by an amino acid sequence of the formula TLTN[EQ]PSE[EQDH]F (SEQ ID NO: 691); and an amino acid sequence MOTIF 24 as represented by an amino acid sequence of the formula LP[RS]QS[RT]N[IV]SF (SEQ ID NO: 692).

In some embodiments a PtIP-83 polypeptide comprises an amino acid sequence MOTIF selected from: an amino acid sequence MOTIF 1 having at least 90% sequence identity to the amino acid sequence as represented by the formula MP[DE]MP[ST][ED]ADWSIFVNE[IVL]EAVAEGMPTEVSEVP[AV]W[KR]AKCKN[MV]AALGRE M[SC]I (SEQ ID NO: 670); an amino acid sequence MOTIF 2 having at least 90% sequence identity to the amino acid sequence as represented by the formula PQLQYRMYG[NS]LI[KRN]QMAQVAQNYD[QR][ED]FK[QR][FL][KR]LFI[IAVL]QNQI[LF]GSYL L[QE]QN[KR]AF (SEQ ID NO: 671); an amino acid sequence MOTIF 3 having at least 90% sequence identity to the amino acid sequence as represented by the formula N[TK]FMQMTPFT[RH]WRLRLSASA[SPKA]EN[AK][EG]LAFPTATA[PL]DSTT[EQ][IV][VA]ITF HVTAIR (SEQ ID NO: 672); an amino acid sequence MOTIF 4 having at least 90% sequence identity to the amino acid sequence as represented by the formula [DN]FTSRHVVK[GD]IPV[SN]LLLDG[EG]DWEFEIPVQ[AG] GMSSFP (SEQ ID NO: 673); an amino acid sequence MOTIF 5 having at least 90% sequence identity to the amino acid sequence as represented by the formula IIHQP[SA]T[RQ][ST]G[IT][VI]YILLQGST[IV]FHDRRR[DE][EQ]V[ML]T[FP]QAA[DAV]PLN[FY][QH]YAYRLDTG (SEQ ID NO: 674); an amino acid sequence MOTIF 6 having at least 90% sequence identity to the amino acid sequence as represented by the formula S[HQ]ADRLAAIQP[AV][DN]LTN[HYF]LEMAT[HQ]MDMRTT[RS][MI]L[IL]GLLN[MI][LM]RIQN AAL[MR]YEY (SEQ ID NO: 675); an amino acid sequence MOTIF 7 having at least 90% sequence identity to the amino acid sequence as represented by the formula [VL]D[RQ]VEFSEVMVIHRMYV[N]RL[SA]DL[ND]V[GA][EQ]L[PE]GA[EG][RK]VKR[VL]YV[FL]ADVVE (SEQ ID NO: 676); an amino acid sequence MOTIF 8 having at least 90% sequence identity to the amino acid sequence as represented by the formula A[DE]RELQMESFH[SA]AVISQ[RK]R[QGE]EL[ND][TD][AT][IF]AKM[DE]R[LM]SLQMEEE[NS D][RG]AMEQA[QR]KEM (SEQ ID NO: 677); an amino acid sequence MOTIF 9 having at least 90% sequence identity to the amino acid sequence as represented by the formula F[VL]TAGATAPGA[AV]ASAGQAV[SN]IAGQAAQ[AG]LRRVVEILE[GQ]LEAVMEVVAA[VI]K (SEQ ID NO: 678); an amino acid sequence MOTIF 10 having at least 90% sequence identity to the amino acid sequence as represented by the formula D[GD][MA][NK]WG[IT]Y[IV][YH][GA]E[KE]V [EQ][RVL]SPL[LYF][PN][SNG][NW][ASP][IY]L[AG V]V[WE]A[DQ]R[CS][TI]IT[SA]A[RFM]HN[HVT][VF] [ND][AER]PG[RW][IV][IR] (SEQ ID NO: 679); an amino acid sequence MOTIF 11 having at least 90% sequence identity to the amino acid sequence as represented by the formula [KV][VK][CA][RGC][PHY]PSP[DE][MIL][MV] SAV[AG][EV]HA[LI N]WL[NS][DK]VLL[QR]WQ[K N]ES[QH][LM]QGT[AE][PSA]YNECLALLGR (SEQ ID NO: 680); an amino acid sequence MOTIF 12 having at least 90% sequence identity to the amino acid sequence as represented by the formula [PN]T[EQ]LT[VAT]WPL[GR] MDTV[AG][ND]LLI[AT][QH]E[NS]AAL[VLS]GL [ITMA]QLG[PQ][S P]S (SEQ ID NO: 681); an amino acid sequence MOTIF 13 having at least 90% sequence identity to the amino acid sequence as represented by the formula [RLC][DLWK][QNPR][MTP][HQR][MIL]PGSVTVI[IV] LCRLLQFP[IT][DG]G[SR][QFR][AS][TAD][TW] (SEQ ID NO: 682); an amino acid sequence MOTIF 14 having at least 90% sequence identity to the amino acid sequence as represented by the formula [TA][SGV][IL]PV[ED]VVTDP [SN]IL[LM]GMQT[TS]V[LH]IAEL (SEQ ID NO: 683); an amino acid sequence MOTIF 15 having at least 90% sequence identity to the amino acid sequence as represented by the formula EGLR[EQ]FQN[RE]QVA[RN]A[VL]FAVL [KS][AS]VA[MQ]I[AG](SEQ ID NO: 684); an amino acid sequence MOTIF 16 having at least 90% sequence identity to the amino acid sequence as represented by the formula W[TS]RVRIRHLEM[QH]F[AV][QK]E[AS][SM][GN] (SEQ ID NO: 685); an amino acid sequence MOTIF 17 having at least 90% sequence identity to the amino acid sequence as represented by the formula Q[IM]S[EQ]LQY [ED]IWVQG[LM][ML]RD[IM]A (SEQ ID NO: 686); an amino acid sequence MOTIF 18 having at least 90% sequence identity to the amino acid sequence as represented by the formula TFTLGSGVTGITSMHGEPSLDP- WNGVSLDSASPTAF (SEQ ID NO: 663); an amino acid sequence MOTIF 19 having at least 90% sequence identity to the amino acid sequence as represented by the formula [MLV]DY[SK][TSK]L[YF][RE]DLNQIS (SEQ ID NO: 687); an amino acid sequence MOTIF 20 having at least 90% sequence identity to the amino acid sequence as represented by the formula L[RHQ]L[PT]FM[QK]LHA[R- IT][VQL][IR]E[QER][NF][VR][KWS][SE] (SEQ ID NO: 688); an amino acid sequence MOTIF 21 having at least 90% sequence identity to the amino acid sequence as represented by the formula V[DN][SA]L[ED]QV[GS][QH] [IL]V[GD]AP (SEQ ID NO: 689); an amino acid sequence MOTIF 22 having at least 90% sequence identity to the amino acid sequence as represented by the formula [IV] [EQH][CAS][VA][MI]K[IM][GV][RP][FI][VG][SL]W (SEQ ID NO: 690); an amino acid sequence MOTIF 23 having at least 90% sequence identity to the amino acid sequence as represented by the formula TLTN[EQ]PSE [EQDH]F (SEQ ID NO: 691); and an amino acid sequence MOTIF 24 having at least 90% sequence identity to the amino acid sequence as represented by the formula LP[RS] QS[RT]N[IV]SF (SEQ ID NO: 692).

In some embodiments a PtIP-83 polypeptide comprises an amino acid sequence MOTIF selected from: an amino acid sequence MOTIF 1 as represented by an amino acid sequence of the formula MP[DE]MP[ST][ED]ADWSIFV- NE[IVL]EAVAEGMPTEVSEVP[AVIL]W[KR]AKCKN [MVIL]AAL GREM[SCT]I (SEQ ID NO: 693); an amino acid sequence MOTIF 2 as represented by an amino acid sequence of the formula PQLQYRMYG[NS]LI[KRNQ]Q- MAQVAQNYD[QRNK][ED]FK[QRNK][FL][KR]LFI [IAVL]QNQI[L FIV]GSYLL[QEND]QN[KR]AF (SEQ ID NO: 694); an amino acid sequence MOTIF 3 as represented by an amino acid sequence of the formula N[TKSR]F- MQMTPFT[RHK]WRLRLSASA[SPKATR]EN[AKR] [EG]LAFPTATA[PLIV]DSTT[EQ ND][IVL][VAIL]ITF- HVTAIR (SEQ ID NO: 695); an amino acid sequence MOTIF 4 as represented by an amino acid sequence of the formula [DNQE]FTSRHWK[GDE]IPV[SNTQ]LLLDG [EGD]DWEFEIPVQ[AG]GMSSFP (SEQ ID NO: 696); an amino acid sequence MOTIF 5 as represented by an amino acid sequence of the formula IIHQP[SAT]T[RQKN][ST]G [ITLVS][VIL]YILLQGST[IVL]FHDRRR[DE][EQDN]V [MLIV]T[FP]QA A[DAVEIL]PLN[FY][QHN]YAY- RLDTG (SEQ ID NO: 697); an amino acid sequence MOTIF 6 as represented by an amino acid sequence of the formula S[HQN]ADRLAAIQP[AVIL][DN]LTN[HYF]LE- MAT[HQN]MDMRTT[RSKT][MILV]L[ILV]GLLN[M ILV][LMIV]RIQNAAL[MRILVK]YEY (SEQ ID NO: 698); an amino acid sequence MOTIF 7 as represented by an amino acid sequence of the formula [VLI]D[RQKN]VEF- SEVMVIHRMYV[N]RL[SAT]DL[NDQE]V[GA][EQND] L[PED]GA[EGD][RK]VKR[VLI]YV[FLIV]ADWE (SEQ ID NO: 699); an amino acid sequence MOTIF 8 as repre- sented by an amino acid sequence of the formula A[DE] RELQMESFH[SAT]AVISQ[RK]R[QGEND]EL[NDQE] [TDSE][ATS][IFLV]AKM[DE]R[LMI V]SLQMEEE [NSDQET][RGK]AMEQA[QRNK]KEM (SEQ ID NO: 700); an amino acid sequence MOTIF 9 as represented by an amino acid sequence of the formula F[VLI]TAGATAPGA [AVIL]ASAGQAV[SNTQ]IAGQAAQ[AG]LRRVVEILE [GQN]LEAVMEWA A[VIL]K (SEQ ID NO: 701); an amino acid sequence MOTIF 10 as represented by an amino acid sequence of the formula D[GDE][MA][NKQK]WG [ITLVS]Y[IVL][YH][GA]E[KERD]V[EQND][RVLKI] SPL[LYFIV][PNQ][S NGTQ][NWQ][ASPT][IYLV]L [AGVIL]V[WED]A[DQNE]R[CST][TISLV]IT[SAT]A [RFMK]HN[HV TILS][VFIL][NDQE][AERDK]PG[RWK] [IVL][IRLVK] (SEQ ID NO: 702); an amino acid sequence MOTIF 11 as represented by an amino acid sequence of the formula [KVRIL][VKRIL][CA][RGCK][PHY]PSP[DE] [MILV][MVIL]SAV[AG][EVDIL]HA[LINVQ]WL[NSQ T][DKER]VLL[QRNK]VVQ[KNRQ]ES[QHN][LMIV] QGT[AED][PSAT]YNECLALLGR (SEQ ID NO: 703); an amino acid sequence MOTIF 12 as represented by an amino acid sequence of the formula [PNQ]T[EQDN]LT[VATILS] WPL[GRK]MDTV[AG][NDQE]LLI[ATS][QHN]E [NSQT]AAL[VLSIT]GL[ITMALVS]QLG[PQN][SPT]S (SEQ ID NO: 704); an amino acid sequence MOTIF 13 as represented by an amino acid sequence of the formula [RLCKIV][DLWKEIVR][QNPRK][MTP][HQR][MILV] PGSVTVI[IVL]LCRLLQFP[ITLVS][DGE]G[SRTK] [QFRNK][AST][TADES][TWS] (SEQ ID NO: 705); an amino acid sequence MOTIF 14 as represented by an amino acid sequence of the formula [TA][SGVTIL][ILV]PV[ED] WTDP[SNTQ]IL[LMIV]GMQT[TS]V[LHIV]IAEL (SEQ ID NO: 706); an amino acid sequence MOTIF 15 as repre- sented by an amino acid sequence of the formula EGLR [EQND]FQN[REKD]QVA[RNKQ]A[VLI]FAVL[KSRT] [AST]VA[MQN]I[AG] (SEQ ID NO: 707); an amino acid sequence MOTIF 16 as represented by an amino acid sequence of the formula W[TS]RVRIRHLEM[QHN]F [AVIL][QKNR]E[AST][SMT][GNQ] (SEQ ID NO: 708); an amino acid sequence MOTIF 17 as represented by an amino acid sequence of the formula Q[IMLV]S[EQND] LQY[ED]IWVQG[LMIV][MLIV]RD[IMLV]A (SEQ ID NO: 709); an amino acid sequence MOTIF 18 as represented by an amino acid sequence of the formula TFTLGSGVT-GITSMHGEPSLDPWNGVSLDSASPTAF (SEQ ID NO: 663); an amino acid sequence MOTIF 19 as represented by an amino acid sequence of the formula [MLVI]DY[SKTR][TSKR]L[YF][REKD]DLNQIS (SEQ ID NO: 710); an amino acid sequence MOTIF 20 as represented by an amino acid sequence of the formula L[RHQKN]L[PTS]FM[QKNR]LHA[RITKLVS][VQLIN][IRLVK]E[QERNDK][NFQ][VRILK][KWSR T][SETD] (SEQ ID NO: 711); an amino acid sequence MOTIF 21 as represented by an amino acid sequence of the formula V[DNQE][SAT]L[ED]QV[GST][QHN][ILV]V[GDE]AP (SEQ ID NO: 712); an amino acid sequence MOTIF 22 as represented by an amino acid sequence of the formula [IVL][EQHND][CAST][VAIL][MILV]K[IMLV][GVIL][RPK][FILV][VGIL][SLTIV]W (SEQ ID NO: 713); an amino acid sequence MOTIF 23 as represented by an amino acid sequence of the formula TLTN[EQDN]PSE[EQDHN]F (SEQ ID NO: 714); and an amino acid sequence MOTIF 24 as represented by an amino acid sequence of the formula LP[RSKT]QS[RTKS]N[IVL]SF (SEQ ID NO: 715).

In some embodiments a PtIP-83 polypeptide comprises an amino acid sequence MOTIF selected from: an amino acid sequence MOTIF 1 having at least 90% sequence identity to the amino acid sequence as represented by the formula MP[DE]MP[ST][ED]ADWSIFVNE[IVL]EAVAEGMPT-EVSEVP[AVIL]W[KR]AKCKN[MVIL]AAL GREM[SCT]I (SEQ ID NO: 693); an amino acid sequence MOTIF 2 having at least 90% sequence identity to the amino acid sequence as represented by the formula PQLQYRMYG[NS]LI[KRNQ]QMAQVAQNYD[QRNK][ED]FK[QRNK][FL][KR]LFI[IAVL]QNQI[L FIV]GSYLL[QEND]QN[KR]AF (SEQ ID NO: 694); an amino acid sequence MOTIF 3 having at least 90% sequence identity to the amino acid sequence as represented by the formula N[TKSR]FMQMT-PFT[RHK]WRLRLSASA[SPKATR]EN[AKR][EG]LAFPTATA[PLIV]DSTT[EQ ND][IVL][VAIL]ITF-HVTAIR (SEQ ID NO: 695); an amino acid sequence MOTIF 4 having at least 90% sequence identity to the amino acid sequence as represented by the formula [DNQE]FTS-RHWK[GDE]IPV[SNTQ]LLLDG[EGD]DWEFEIPVQ[AG]GMSSFP (SEQ ID NO: 696); an amino acid sequence MOTIF 5 having at least 90% sequence identity to the amino acid sequence as represented by the formula IIHQP[SAT]T[RQKN][ST]G[ITLVS][VIL]YILLQGST[IVL]FHDRRR[DE][EQDN]V[MLIV]T[FP]QA A[DAVEIL]PLN[FY][QHN]YAYRLDTG (SEQ ID NO: 697); an amino acid sequence MOTIF 6 having at least 90% sequence identity to the amino acid sequence as represented by the formula S[HQN]ADRLAAIQP[AVIL][DN]LTN[HYF]LEMAT[HQN]MDMRTT[RSKT][MILV]L[ILV]GLLN[M ILV][LMIV]RIQNAAL[MRILVK]YEY (SEQ ID NO: 698); an amino acid sequence MOTIF 7 having at least 90% sequence identity to the amino acid sequence as represented by the formula [VLI]D[RQKN]VEFSEVMVIHRMYV[N]RL[SAT]DL[NDQE]V[GA][EQND]L[PED]GA[EGD][RK]VKR[VLI]YV[FLIV]ADWE (SEQ ID NO: 699); an amino acid sequence MOTIF 8 having at least 90% sequence identity to the amino acid sequence as represented by the formula A[DE]RELQMESFH[SAT]AVISQ[RK]R[QGEND]EL[NDQE][TDSE][ATS][IFLV]AKM[DE]R[LMI V]SLQMEEE[NSDQET][RGK]AMEQA[QRNK]KEM (SEQ ID NO: 700); an amino acid sequence MOTIF 9 having at least 90% sequence identity to the amino acid sequence as represented by the formula F[VLI]TAGATAP-GA[AVIL]ASAGQAV[SNTQ]IAGQAAQ[AG]LRRV-VEILE[GQN]LEAVMEVVA A[VIL]K (SEQ ID NO: 701); an amino acid sequence MOTIF 10 having at least 90% sequence identity to the amino acid sequence as represented by the formula D[GDE][MA][NKQK]WG[ITLVS]Y[IVL][YH][GA]E[KERD]V[EQND][RVLKI]SPL[LYFIV][PNQ][S NGTQ][NWQ][ASPT][IYLV]L[AGVIL]V[WED]A[DQNE]R[CST][TISLV]IT[SAT]A[RFMK]HN[HV TILS][VFIL][NDQE][AERDK]PG[RWK][IVL][IRLVK] (SEQ ID NO: 702); an amino acid sequence MOTIF 11 having at least 90% sequence identity to the amino acid sequence as represented by the formula [KVRIL][VKRIL][CA][RGCK][PHY]PSP[DE][MILV][MVIL]SAV[AG][EVDIL]HA[LINVQ]WL[NSQ T][DKER]VLL[QRNK]VVQ[KNRQ]ES[QHN][LMIV]QGT[AED][PSAT]YNECLALLGR (SEQ ID NO: 703); an amino acid sequence MOTIF 12 having at least 90% sequence identity to the amino acid sequence as represented by the formula [PNQ]T[EQDN]LT[VATILS]WPL[GRK]MDTV[AG][NDQE]LLI[ATS][QHN]E[NSQT]AAL[VLSIT]GL[IT-MALVS]QLG[PQN][SPT]S (SEQ ID NO: 704); an amino acid sequence MOTIF 13 having at least 90% sequence identity to the amino acid sequence as represented by the formula [RLCKIV][DLWKEIVR][QNPRK][MTP][HQR][MILV]PGSVTVI[IVL]LCRLLQFP[ITLVS][DGE]G[SRTK][QFRNK][AST][TADES][TWS] (SEQ ID NO: 705); an amino acid sequence MOTIF 14 having at least 90% sequence identity to the amino acid sequence as represented by the formula [TA][SGVTIL][ILV]PV[ED]VVTDP[SNTQ]IL[LMIV]GMQT[TS]V[LHIV]IAEL (SEQ ID NO: 706); an amino acid sequence MOTIF 15 having at least 90% sequence identity to the amino acid sequence as represented by the formula EGLR[EQND]FQN[REKD]Q-VA[RNKQ]A[VLI]FAVL[KSRT][AST]VA[MQN]I[AG] (SEQ ID NO: 707); an amino acid sequence MOTIF 16 having at least 90% sequence identity to the amino acid sequence as represented by the formula W[TS]RVRIRHLEM[QHN]F[AVIL][QKNR]E[AST][SMT][GNQ] (SEQ ID NO: 708); an amino acid sequence MOTIF 17 having at least 90% sequence identity to the amino acid sequence as represented by the formula Q[IMLV]S[EQND]LQY[ED]IWVQG[LMIV][MLIV]RD[IMLV]A (SEQ ID NO: 709); an amino acid sequence MOTIF 18 having at least 90% sequence identity to the amino acid sequence as represented by the formula TFTLGSGVTGITSMH-GEPSLDPWNGVSLDSASPTAF (SEQ ID NO: 663); an amino acid sequence MOTIF 19 having at least 90% sequence identity to the amino acid sequence as represented by the formula [MLVI]DY[SKTR][TSKR]L[YF][REKD]DLNQIS (SEQ ID NO: 710); an amino acid sequence MOTIF 20 having at least 90% sequence identity to the amino acid sequence as represented by the formula L[RHQKN]L[PTS]FM[QKNR]LHA[RITKLVS][VQLIN][IRLVK]E[QERNDK][NFQ][VRILK][KWSR T][SETD] (SEQ ID NO: 711); an amino acid sequence MOTIF 21 having at least 90% sequence identity to the amino acid sequence as represented by the formula V[DNQE][SAT]L[ED]QV[GST][QHN][ILV]V[GDE]AP (SEQ ID NO: 712); an amino acid sequence MOTIF 22 having at least 90% sequence identity to the amino acid sequence as represented by the formula [IVL][EQHND][CAST][VAIL][MILV]K[IMLV][GVIL][RPK][FILV][VGIL][SLTIV]W (SEQ ID NO: 713); an amino acid sequence MOTIF 23 having at least 90% sequence identity to the amino acid sequence as represented by the formula TLTN[EQDN]PSE[EQDHN]F (SEQ ID NO: 714); and an amino acid sequence MOTIF 24 having at least 90% sequence identity to the amino acid sequence as represented by the formula LP[RSKT]QS[RTK-S]N[IVL]SF (SEQ ID NO: 715).

In some embodiment a PtIP-83 polypeptide comprises, sequentially from the N-terminus to the C-terminus, an amino acid sequence MOTIF selected from: MOTIF 19 (SEQ ID NO: 664, SEQ ID NO: 687 or SEQ ID NO: 710), MOTIF 7 (SEQ ID NO: 652, SEQ ID NO: 676 or SEQ ID NO: 699), MOTIF 13 (SEQ ID NO: 658, SEQ ID NO: 682 or SEQ ID NO: 705), MOTIF 20 (SEQ ID NO: 665, SEQ ID NO: 688 or SEQ ID NO: 711), MOTIF 10 (SEQ ID NO: 655, SEQ ID NO: 679 or SEQ ID NO: 702), MOTIF 18 (SEQ ID NO: 663), MOTIF 24 (SEQ ID NO: 669, SEQ ID NO: 692 or SEQ ID NO: 715), MOTIF 14 (SEQ ID NO: 659, SEQ ID NO: 683 or SEQ ID NO: 706), MOTIF 11 (SEQ ID NO: 656, SEQ ID NO: 680 or SEQ ID NO: 703), MOTIF 22 (SEQ ID NO: 667, SEQ ID NO: 690 or SEQ ID NO: 713), MOTIF 2 (SEQ ID NO: 647, SEQ ID NO: 671 or SEQ ID NO: 694), MOTIF 8 (SEQ ID NO: 653, SEQ ID NO: 677 or SEQ ID NO: 700), MOTIF 15 (SEQ ID NO: 660, SEQ ID NO: 684 or SEQ ID NO: 707), MOTIF 9 (SEQ ID NO: 654, SEQ ID NO: 678 or SEQ ID NO: 701), MOTIF 21 (SEQ ID NO: 666, SEQ ID NO: 689 or SEQ ID NO: 712), MOTIF 1 (SEQ ID NO: 646, SEQ ID NO: 670 or SEQ ID NO: 693), MOTIF 17 (SEQ ID NO: 662, SEQ ID NO: 686 or SEQ ID NO: 709), MOTIF 6 (SEQ ID NO: 651, SEQ ID NO: 675 or SEQ ID NO: 698), MOTIF 12 (SEQ ID NO: 657, SEQ ID NO: 681 or SEQ ID NO: 704), MOTIF 4 (SEQ ID NO: 649, SEQ ID NO: 673 or SEQ ID NO: 696), MOTIF 16 (SEQ ID NO: 661, SEQ ID NO: 685 or SEQ ID NO: 708), MOTIF 5 (SEQ ID NO: 650, SEQ ID NO: 674 or SEQ ID NO: 697), MOTIF 23 (SEQ ID NO: 668, SEQ ID NO: 691 or SEQ ID NO: 714), and MOTIF 3 (SEQ ID NO: 648, SEQ ID NO: 672 or SEQ ID NO: 695).

In some embodiments a PtIP-83 polypeptide comprises, sequentially from the N-terminus to the C-terminus, an amino acid sequence MOTIF selected from: MOTIF 19 (SEQ ID NO: 664, SEQ ID NO: 687 or SEQ ID NO: 710), MOTIF 7 (SEQ ID NO: 652, SEQ ID NO: 676 or SEQ ID NO: 699), MOTIF 13 (SEQ ID NO: 658, SEQ ID NO: 682 or SEQ ID NO: 705), MOTIF 20 (SEQ ID NO: 665, SEQ ID NO: 688 or SEQ ID NO: 711), MOTIF 14 (SEQ ID NO: 659, SEQ ID NO: 683 or SEQ ID NO: 706), MOTIF 2 (SEQ ID NO: 647, SEQ ID NO: 671 or SEQ ID NO: 694), MOTIF 8 (SEQ ID NO: 653, SEQ ID NO: 677 or SEQ ID NO: 700), MOTIF 15 (SEQ ID NO: 660, SEQ ID NO: 684 or SEQ ID NO: 707), MOTIF 9 (SEQ ID NO: 654, SEQ ID NO: 678 or SEQ ID NO: 701), MOTIF 21 (SEQ ID NO: 666, SEQ ID NO: 689 or SEQ ID NO: 712), MOTIF 1 (SEQ ID NO: 646, SEQ ID NO: 670 or SEQ ID NO: 693), MOTIF 17 (SEQ ID NO: 662, SEQ ID NO: 686 or SEQ ID NO: 709), MOTIF 6 (SEQ ID NO: 651, SEQ ID NO: 675 or SEQ ID NO: 698), MOTIF 12 (SEQ ID NO: 657, SEQ ID NO: 681 or SEQ ID NO: 704), MOTIF 4 (SEQ ID NO: 649, SEQ ID NO: 673 or SEQ ID NO: 696), MOTIF 16 (SEQ ID NO: 661, SEQ ID NO: 685 or SEQ ID NO: 708), MOTIF 5 (SEQ ID NO: 650, SEQ ID NO: 674 or SEQ ID NO: 697), MOTIF 23 (SEQ ID NO: 668, SEQ ID NO: 691 or SEQ ID NO: 714), and MOTIF 3 (SEQ ID NO: 648, SEQ ID NO: 672 or SEQ ID NO: 695).

In some embodiments a PtIP-83 polypeptide comprises, sequentially from the N-terminus to the C-terminus, the amino acid sequence MOTIFs: MOTIF 19 (SEQ ID NO: 664, SEQ ID NO: 687 or SEQ ID NO: 710), MOTIF 7 (SEQ ID NO: 652, SEQ ID NO: 676 or SEQ ID NO: 699), MOTIF 13 (SEQ ID NO: 658, SEQ ID NO: 682 or SEQ ID NO: 705), MOTIF 20 (SEQ ID NO: 665, SEQ ID NO: 688 or SEQ ID NO: 711), MOTIF 10 (SEQ ID NO: 655, SEQ ID NO: 679 or SEQ ID NO: 702), MOTIF 18 (SEQ ID NO: 663), MOTIF 24 (SEQ ID NO: 669, SEQ ID NO: 692 or SEQ ID NO: 715), MOTIF 14 (SEQ ID NO: 659, SEQ ID NO: 683 or SEQ ID NO: 706), MOTIF 11 (SEQ ID NO: 656, SEQ ID NO: 680 or SEQ ID NO: 703), MOTIF 22 (SEQ ID NO: 667, SEQ ID NO: 690 or SEQ ID NO: 713), MOTIF 2 (SEQ ID NO: 647, SEQ ID NO: 671 or SEQ ID NO: 694), MOTIF 8 (SEQ ID NO: 653, SEQ ID NO: 677 or SEQ ID NO: 700), MOTIF 15 (SEQ ID NO: 660, SEQ ID NO: 684 or SEQ ID NO: 707), MOTIF 9 (SEQ ID NO: 654, SEQ ID NO: 678 or SEQ ID NO: 701), MOTIF 21 (SEQ ID NO: 666, SEQ ID NO: 689 or SEQ ID NO: 712), MOTIF 1 (SEQ ID NO: 646, SEQ ID NO: 670 or SEQ ID NO: 693), MOTIF 17 (SEQ ID NO: 662, SEQ ID NO: 686 or SEQ ID NO: 709), MOTIF 6 (SEQ ID NO: 651, SEQ ID NO: 675 or SEQ ID NO: 698), MOTIF 12 (SEQ ID NO: 657, SEQ ID NO: 681 or SEQ ID NO: 704), MOTIF 4 (SEQ ID NO: 649, SEQ ID NO: 673 or SEQ ID NO: 696), MOTIF 16 (SEQ ID NO: 661, SEQ ID NO: 685 or SEQ ID NO: 708), MOTIF 5 (SEQ ID NO: 650, SEQ ID NO: 674 or SEQ ID NO: 697), MOTIF 23 (SEQ ID NO: 668, SEQ ID NO: 691 or SEQ ID NO: 714), and MOTIF 3 (SEQ ID NO: 648, SEQ ID NO: 672 or SEQ ID NO: 695).

In some embodiments a PtIP-83 polypeptide comprises, sequentially from the N-terminus to the C-terminus, the amino acid sequence MOTIFs: MOTIF 19 (SEQ ID NO: 664, SEQ ID NO: 687 or SEQ ID NO: 710), MOTIF 7 (SEQ ID NO: 652, SEQ ID NO: 676 or SEQ ID NO: 699), MOTIF 13 (SEQ ID NO: 658, SEQ ID NO: 682 or SEQ ID NO: 705), MOTIF 20 (SEQ ID NO: 665, SEQ ID NO: 688 or SEQ ID NO: 711), MOTIF 14 (SEQ ID NO: 659, SEQ ID NO: 683 or SEQ ID NO: 706), MOTIF 2 (SEQ ID NO: 647, SEQ ID NO: 671 or SEQ ID NO: 694), MOTIF 8 (SEQ ID NO: 653, SEQ ID NO: 677 or SEQ ID NO: 700), MOTIF 15 (SEQ ID NO: 660, SEQ ID NO: 684 or SEQ ID NO: 707), MOTIF 9 (SEQ ID NO: 654, SEQ ID NO: 678 or SEQ ID NO: 701), MOTIF 21 (SEQ ID NO: 666, SEQ ID NO: 689 or SEQ ID NO: 712), MOTIF 1 (SEQ ID NO: 646, SEQ ID NO: 670 or SEQ ID NO: 693), MOTIF 17 (SEQ ID NO: 662, SEQ ID NO: 686 or SEQ ID NO: 709), MOTIF 6 (SEQ ID NO: 651, SEQ ID NO: 675 or SEQ ID NO: 698), MOTIF 12 (SEQ ID NO: 657, SEQ ID NO: 681 or SEQ ID NO: 704), MOTIF 4 (SEQ ID NO: 649, SEQ ID NO: 673 or SEQ ID NO: 696), MOTIF 16 (SEQ ID NO: 661, SEQ ID NO: 685 or SEQ ID NO: 708), MOTIF 5 (SEQ ID NO: 650, SEQ ID NO: 674 or SEQ ID NO: 697), MOTIF 23 (SEQ ID NO: 668, SEQ ID NO: 691 or SEQ ID NO: 714), and MOTIF 3 (SEQ ID NO: 648, SEQ ID NO: 672 or SEQ ID NO: 695).

In some embodiments a PtIP-83 polypeptide comprises, sequentially from the N-terminus to the C-terminus: a Region A of between about 200 to about 300 amino acids in length comprising an amino acid sequence MOTIF of: MOTIF 19 (SEQ ID NO: 664, SEQ ID NO: 687 or SEQ ID NO: 710), MOTIF 7 (SEQ ID NO: 652, SEQ ID NO: 676 or SEQ ID NO: 699), MOTIF 13 (SEQ ID NO: 658, SEQ ID NO: 682 or SEQ ID NO: 705), MOTIF 20 (SEQ ID NO: 665, SEQ ID NO: 688 or SEQ ID NO: 711), MOTIF 10 (SEQ ID NO: 655, SEQ ID NO: 679 or SEQ ID NO: 702), MOTIF 18 (SEQ ID NO: 663), MOTIF 24 (SEQ ID NO: 669, SEQ ID NO: 692 or SEQ ID NO: 715), and/or MOTIF 14 having a predominantly nonconserved secondary structure; a Region B of between about 380 to about 465 amino acids in length comprising an amino acid sequence MOTIF of MOTIF 22 (SEQ ID NO: 667, SEQ ID NO: 690 or SEQ ID NO: 713), MOTIF 2 (SEQ ID NO: 647, SEQ ID NO: 671 or SEQ ID NO: 694), MOTIF 8 (SEQ ID NO: 653, SEQ ID NO: 677 or SEQ ID NO: 700), MOTIF 15 (SEQ ID NO: 660, SEQ ID NO: 684 or SEQ ID NO: 707), MOTIF 9 (SEQ ID NO: 654, SEQ ID NO: 678 or SEQ ID NO: 701), MOTIF 21 (SEQ ID NO: 666, SEQ ID NO: 689 or SEQ ID NO: 712), MOTIF 1 (SEQ ID NO: 646, SEQ ID NO: 670 or SEQ ID NO: 693), MOTIF 17 (SEQ ID NO: 662, SEQ ID NO: 686 or SEQ ID NO: 709), MOTIF 6 (SEQ ID NO: 651, SEQ ID NO: 675 or SEQ ID NO: 698), and/or MOTIF 12 and having a predominately alpha helical structure; and a Region C of between about 150 to about 180 amino acids in length comprising an amino acid sequence MOTIF of MOTIF 16 (SEQ ID NO: 661, SEQ ID NO: 685 or SEQ ID NO: 708), MOTIF 5 (SEQ ID NO: 650, SEQ ID NO: 674 or SEQ ID NO: 697), MOTIF 23 (SEQ ID NO: 668, SEQ ID NO: 691 or SEQ ID NO: 714), and/or MOTIF 3 having a consensus secondary structure comprising predominately beta strand structure.

In some embodiments a PtIP-83 polypeptide comprises sequentially from the N-terminus to the C-terminus: a Region A of between about 200 to about 300 amino acids in length having predominantly a nonconserved secondary structure; a Region B of between about 380 to about 465 amino acids in length having a consensus secondary structure comprising 8 to 10 segments of predominately alpha helical structure; and a Region C of between about 150 to about 180 amino acids in length having a consensus secondary structure comprising 6 to 8 segments of predominately beta strand structure. As used herein "predominantly a nonconserved secondary structure" means that the regions of secondary structure don't consistently align within the family of PtIP polypeptides. As used herein "predominately alpha helical structure" means that secondary structure prediction may have one or more gap of between 1 to 4 amino acids of coil and/or beta strand structure intervening in the alpha helix structure. As used herein "predominately beta strand structure" means that secondary structure prediction may have a gap of between 1 to 4 amino acids of coil and/or alpha helix structure intervening in the beta strand structure. In some embodiments the secondary structure is generated by the PSIPRED, top ranked secondary structure prediction method (Jones D T. (1999) *J. Mol. Biol.* 292: 195-202).

In some embodiments a PtIP-83 polypeptide comprises sequentially from the N-terminus to the C-terminus: a Region A of between about 200 to about 300 amino acids in length having a predominantly nonconserved secondary structure; a Region B of between about 380 to about 465 amino acids in length having a consensus secondary structure comprising nine segments of predominately alpha helical structure; and a Region C of between about 150 to about 180 amino acids in length having a consensus secondary structure comprising seven segments of predominately beta strand structure.

In some embodiments a PtIP-83 polypeptide comprises sequentially from the N-terminus to the C-terminus: a Region A of between about 200 to about 300 amino acids in length having a flexible consensus secondary structure, wherein the Region A comprises a conserved beta strand 1 (β1a) of between about 4 and about 12 amino acids in length within about amino acid residue 30 to about amino acid residue 130 from the N-terminus of the PtIP-83 polypeptide; a Region B of between about 380 to about 465 amino acids in length having a consensus secondary structure comprising nine segments of predominately alpha helical structure; and a Region C of between about 150 to about 180 amino acids in length having a consensus secondary structure comprising seven segments of predominately beta strand structure. As used herein, the term "about" when used in the context of the lower/upper limit of the length of a secondary structural element means the greater of −/+ an integer of up to −/+20% of the length of the secondary structural element or −/+1 amino acid. By means of example, a secondary structure element of between about 3 amino acids and about 23 amino acids in length means a secondary structure element of between 2 and 27 amino acids in length.

In some embodiments a PtIP-83 polypeptide comprises sequentially from the N-terminus to the C-terminus: a Region A of between about 200 to about 300 amino acids in length having a flexible consensus secondary structure, wherein the Region A comprises a conserved beta strand 1 (β1a) of between about 4 and about 12 amino acids in length, a coil of between about 10 and about 20 amino acids in length and a beta strand 2 (β1b) of between about 4 and about 12 amino acids in length, within about amino acid residue 30 to about amino acid residue 165 from the N-terminus of the PtIP-83 polypeptide; a Region B of between about 380 to about 465 amino acids in length having a consensus secondary structure comprising nine segments of predominately alpha helical structure; and a Region C of between about 150 to about 180 amino acids in length having a consensus secondary structure comprising seven segments of predominately beta strand structure.

In some embodiments a PtIP-83 polypeptide comprises sequentially from the N-terminus to the C-terminus: a Region A of between about 200 to about 300 amino acids in length having a predominantly nonconserved secondary structure; a Region B of between about 380 to about 465 amino acids in length having a consensus secondary structure comprising sequentially: i) an alpha helix-1 of between about 10 and about 26 amino acids in length; ii) a coil-1 of between about 2 and about 8 amino acids in length flanked by alpha helix-1 and alpha helix-2; iii) an alpha helix-2 of between about 15 and about 24 amino acids in length; iv) a coil-2 of between about 4 and about 14 amino acids in length flanked by alpha helix-2 and alpha helix-3; v) an alpha helix 3 of between about 15 and about 27 amino acids in length; vi) a coil-3 of between about 11 and about 13 amino acids in length flanked by alpha helix-3 and alpha helix-4; vii) an alpha helix-4 of about 180 amino acids in length; viii) a coil-4 of between about 4 and about 5 amino acids in length flanked by alpha helix-4 and alpha helix-5; ix) an alpha helix-5 of between about 50 and about 54 amino acids in length; x) a coil-5 of between about 11 and about 17 amino acids in length flanked by alpha helix-5 and alpha helix-6; xi) an alpha helix-6 of between about 15 and about 16 amino acids in length; xii) a coil-6 of between about 6 and about 9 amino acids in length flanked by alpha helix-6 and alpha helix-7; xiii) an alpha helix-7 of between about 49 and about 55 amino acids in length; xiv) a coil-7 of between about 3 and about 8 amino acids in length flanked by alpha helix-7 and alpha helix-8; xv) an alpha helix-8 of between about 33 and about 36 amino acids in length; xvi) a coil-8 of between about 14 and about 16 amino acids in length flanked by alpha helix-8 and alpha helix-9; xvii) an alpha helix-9 of between about 16 and about 23 amino acids in length; xviii) a coil-9 of between about 21 and about 28 amino acids in length flanked by alpha helix-9 and Region C; and a Region C of between about 150 to about 180 amino acids in length having a consensus secondary structure comprising seven segments of predominately beta strand structure.

In some embodiments a PtIP-83 polypeptide comprises sequentially from the N-terminus to the C-terminus: a Region A of between about 200 to about 300 amino acids in length having a predominantly nonconserved secondary structure; a Region B of between about 380 to about 465 amino acids in length having a consensus secondary structure comprising nine segments of predominately alpha helical structure; and a Region C of between about 150 to about 180 amino acids in length having a consensus secondary structure comprising sequentially: i) a beta strand-1 (β1) of between about 3 amino acids and about 5 amino acids in length; ii) a coil of between about 13 amino acids and about 17 amino acids in length; iii) a beta strand-2 (β2) of between about 7 amino acids and about 11 amino acids in length; iv) a coil of between about 17 amino acids and about 23 amino acids in length; v) a beta strand-3 (β3) of between about 5 amino acids and about 7 amino acids in length; vi) a coil of between about 12 amino acids and about 14 amino acids in length; vii) a beta strand-4 (β4) of between about 5 amino acids and about 6 amino acids in length; viii) a coil of between about 2 amino acids and about 7 amino acids in length; ix) a beta strand-5 (β5) of between about 5 amino acids and about 7 amino acids in length; x) a coil of between about 26 amino acids and about 28 amino acids in length; xi) a beta strand-6 (β6) of between about 5 amino acids and about 7 amino acids in length; xii) a coil of between about 16 amino acids and about 20 amino acids in length; and xiii) a beta strand-1 (β7) of between about 13 amino acids and about 17 amino acids in length.

In some embodiments a PtIP-83 polypeptide comprises sequentially from the N-terminus to the C-terminus: a Region A of between about 200 to about 300 amino acids in length having a predominantly nonconserved secondary structure; a Region B of between about 380 to about 465 amino acids in length having a consensus secondary structure comprising sequentially: i) an alpha helix-1 of between about 10 and about 26 amino acids in length; ii) a coil-1 of between about 2 and about 8 amino acids in length flanked by alpha helix-1 and alpha helix-2; iii) an alpha helix-2 of between about 15 and about 24 amino acids in length; iv) a coil-2 of between about 4 and about 14 amino acids in length flanked by alpha helix-2 and alpha helix-3; v) an alpha helix 3 of between about 15 and about 27 amino acids in length; vi) a coil-3 of between about 11 and about 13 amino acids in length flanked by alpha helix-3 and alpha helix-4; vii) an alpha helix-4 of about 24 180 amino acids in length; viii) a coil-4 of between about 4 and about 5 amino acids in length flanked by alpha helix-4 and alpha helix-5; ix) an alpha helix-5 of between about 50 and about 54 amino acids in length; x) a coil-5 of between about 11 and about 17 amino acids in length flanked by alpha helix-5 and alpha helix-6; xi) an alpha helix-6 of between about 15 and about 16 amino acids in length; xii) a coil-6 of between about 6 and about 9 amino acids in length flanked by alpha helix-6 and alpha helix-7; xiii) an alpha helix-7 of between about 49 and about 55 amino acids in length; xiv) a coil-7 of between about 3 and about 8 amino acids in length flanked by alpha helix-7 and alpha helix-8; xv) an alpha helix-8 of between about 33 and about 36 amino acids in length; xvi) a coil-8 of between about 14 and about 16 amino acids in length flanked by alpha helix-8 and alpha helix-9; xvii) an alpha helix-9 of between about 16 and about 23 amino acids in length; xviii) a coil-9 of between about 21 and about 28 amino acids in length flanked by alpha helix-9 and Region C; and a Region C of between about 150 to about 180 amino acids in length having a consensus secondary structure comprising sequentially: i) a beta strand-1 (β1) of between about 3 amino acids and about 5 amino acids in length; ii) a coil of between about 13 amino acids and about 17 amino acids in length; iii) a beta strand-2 (β2) of between about 7 amino acids and about 11 amino acids in length; iv) a coil of between about 17 amino acids and about 23 amino acids in length; v) a beta strand-3 (β3) of between about 5 amino acids and about 7 amino acids in length; vi) a coil of between about 12 amino acids and about 14 amino acids in length; vii) a beta strand-4 (β4) of between about 5 amino acids and about 6 amino acids in length; viii) a coil of between about 2 amino acids and about 7 amino acids in length; ix) a beta strand-5 (β5) of between about 5 amino acids and about 7 amino acids in length; x) a coil of between about 26 amino acids and about 28 amino acids in length; xi) a beta strand-6 (β6) of between about 5 amino acids and about 7 amino acids in length; xii) a coil of between about 16 amino acids and about 20 amino acids in length; and xiii) a beta strand-1 (β7) of between about 13 amino acids and about 17 amino acids in length.

In some embodiments a PtIP-83 polypeptide comprises sequentially from the N-terminus to the C-terminus: a Region A of between about 200 to about 300 amino acids in length having a flexible consensus secondary structure, wherein the Region A comprises a conserved beta strand 1 (β1a) of between about 4 and about 12 amino acids in length within about amino acid residue 30 to about amino acid residue 130 from the N-terminus of the PtIP-83 polypeptide; a Region B of between about 380 to about 465 amino acids in length having a consensus secondary structure comprising sequentially: i) an alpha helix-1 of between about 10 and about 26 amino acids in length; ii) a coil-1 of between about 2 and about 8 amino acids in length flanked by alpha helix-1 and alpha helix-2; iii) an alpha helix-2 of between about 15 and about 24 amino acids in length; iv) a coil-2 of between about 4 and about 14 amino acids in length flanked by alpha helix-2 and alpha helix-3; v) an alpha helix 3 of between about 15 and about 27 amino acids in length; vi) a coil-3 of between about 11 and about 13 amino acids in length flanked by alpha helix-3 and alpha helix-4; vii) an alpha helix-4 of about 24 180 amino acids in length; viii) a coil-4 of between about 4 and about 5 amino acids in length flanked by alpha helix-4 and alpha helix-5; ix) an alpha helix-5 of between about 50 and about 54 amino acids in length; x) a coil-5 of between about 11 and about 17 amino acids in length flanked by alpha helix-5 and alpha helix-6; xi) an alpha helix-6 of between about 15 and about 16 amino acids in length; xii) a coil-6 of between about 6 and about 9 amino acids in length flanked by alpha helix-6 and alpha helix-7; xiii) an alpha helix-7 of between about 49 and about 55 amino acids in length; xiv) a coil-7 of between about 3 and about 8 amino acids in length flanked by alpha helix-7 and alpha helix-8; xv) an alpha helix-8 of between about 33 and about 36 amino acids in length; xvi) a coil-8 of between about 14 and about 16 amino acids in length flanked by alpha helix-8 and alpha helix-9; xvii) an alpha helix-9 of between about 16 and about 23 amino acids in length; xviii) a coil-9 of between about 21 and about 28 amino acids in length flanked by alpha helix-9 and Region C; and a Region C of between about 150 to about 180 amino acids in length having a consensus secondary structure comprising sequentially: i) a beta strand-1 (β1) of between about 3 amino acids and about 5 amino acids in length; ii) a coil of between about 13 amino acids and about 17 amino acids in length; iii) a beta strand-2 (β2) of between about 7 amino acids and about 11 amino acids in length; iv) a coil of between about 17 amino acids and about 23 amino acids in length; v) a beta strand-3 (β3) of between about 5 amino acids and about 7 amino acids in length; vi) a coil of between about 12 amino acids and about 14 amino acids in length; vii) a beta strand-4 (β4) of between about 5 amino acids and about 6 amino acids in length; viii) a coil of between about 2 amino acids and about 7 amino acids in length; ix) a beta strand-5 (β5) of between about 5 amino acids and about 7 amino acids in length; x) a coil of between about 26 amino acids and about 28 amino acids in length; xi) a beta strand-6 (β6) of between about 5 amino acids and about 7 amino acids in length; xii) a coil of between about 16 amino acids and about 20 amino acids in length; and xiii) a beta strand-1 (β7) of between about 13 amino acids and about 17 amino acids in length.

In some embodiments a PtIP-83 polypeptide has a calculated molecular weight of between about 70 kD and about 120 kD, between about 75 kD and about 110 kD, and between about 80 kD and about 105 kD, and between about 85 kD and about 105 kD.

In some embodiments the PtIP-83 polypeptide has a modified physical property. As used herein, the term "physical property" refers to any parameter suitable for describing the physical-chemical characteristics of a protein. As used herein, "physical property of interest" and "property of interest" are used interchangeably to refer to physical properties of proteins that are being investigated and/or modified. Examples of physical properties include, but are not limited to net surface charge and charge distribution on the protein surface, net hydrophobicity and hydrophobic residue distribution on the protein surface, surface charge density, surface hydrophobicity density, total count of surface ionizable groups, surface tension, protein size and its distribution in solution, melting temperature, heat capacity, and second virial coefficient. Examples of physical properties also include, but are not limited to solubility, folding, stability, and digestibility. In some embodiments the PtIP-83 polypeptide has increased digestibility of proteolytic fragments in an insect gut. Models for digestion by simulated gastric fluids are known to one skilled in the art (Fuchs, R. L. and J. D. Astwood. *Food Technology* 50: 83-88, 1996; Astwood, J. D., et al *Nature Biotechnology* 14: 1269-1273, 1996; Fu T J et al *J. Agric Food Chem.* 50: 7154-7160, 2002).

In some embodiments variants include polypeptides that differ in amino acid sequence due to mutagenesis. Variant proteins encompassed by the disclosure are biologically active, that is they continue to possess the desired biological activity (i.e. pesticidal activity) of the native protein. In some embodiment the variant will have at least about 10%, at least about 30%, at least about 50%, at least about 70%, at least about 80% or more of the insecticidal activity of the native protein. In some embodiments, the variants may have improved activity over the native protein.

Bacterial genes quite often possess multiple methionine initiation codons in proximity to the start of the open reading frame. Often, translation initiation at one or more of these start codons will lead to generation of a functional protein. These start codons can include ATG codons. However, bacteria such as *Bacillus* sp. also recognize the codon GTG as a start codon, and proteins that initiate translation at GTG codons contain a methionine at the first amino acid. On rare occasions, translation in bacterial systems can initiate at a TTG codon, though in this event the TTG encodes a methionine. Furthermore, it is not often determined a priori which of these codons are used naturally in the bacterium. Thus, it is understood that use of one of the alternate methionine codons may also lead to generation of pesticidal proteins. These pesticidal proteins are encompassed in the present disclosure and may be used in the methods of the present disclosure. It will be understood that, when expressed in plants, it will be necessary to alter the alternate start codon to ATG for proper translation.

In another aspect the PtIP-83 polypeptide may be expressed as a precursor protein with an intervening sequence that catalyzes multi-step, post translational protein splicing. Protein splicing involves the excision of an intervening sequence from a polypeptide with the concomitant joining of the flanking sequences to yield a new polypeptide (Chong, et al., (1996) *J. Biol. Chem.,* 271:22159-22168). This intervening sequence or protein splicing element, referred to as inteins, which catalyze their own excision through three coordinated reactions at the N-terminal and C-terminal splice junctions: an acyl rearrangement of the N-terminal cysteine or serine; a transesterfication reaction between the two termini to form a branched ester or thioester intermediate and peptide bond cleavage coupled to cyclization of the intein C-terminal asparagine to free the intein (Evans, et al., (2000) *J. Biol. Chem.,* 275:9091-9094. The elucidation of the mechanism of protein splicing has led to a number of intein-based applications (Comb, et al., U.S. Pat. No. 5,496,714; Comb, et al., U.S. Pat. No. 5,834,247; Camarero and Muir, (1999) *J. Amer. Chem. Soc.* 121:5597-5598; Chong, et al., (1997) *Gene* 192:271-281, Chong, et al., (1998) *Nucleic Acids Res.* 26:5109-5115; Chong, et al., (1998) *J. Biol. Chem.* 273:10567-10577; Cotton, et al., (1999) *J. Am. Chem. Soc.* 121:1100-1101; Evans, et al., (1999) *J. Biol. Chem.* 274:18359-18363; Evans, et al., (1999) *J. Biol. Chem.* 274:3923-3926; Evans, et al., (1998) *Protein Sci.* 7:2256-2264; Evans, et al., (2000) *J. Biol. Chem.* 275:9091-9094; Iwai and Pluckthun, (1999) *FEBS Lett.* 459:166-172; Mathys, et al., (1999) *Gene* 231:1-13; Mills, et al., (1998) *Proc. Natl. Acad. Sci. USA* 95:3543-3548; Muir, et al., (1998) *Proc. Natl. Acad. Sci. USA* 95:6705-6710; Otomo, et al., (1999) *Biochemistry* 38:16040-16044; Otomo, et al., (1999) *J. Biolmol. NMR* 14:105-114; Scott, et al., (1999) *Proc. Natl. Acad. Sci. USA* 96:13638-13643; Severinov and Muir, (1998) *J. Biol. Chem.* 273:16205-16209; Shingledecker, et al., (1998) *Gene* 207: 187-195; Southworth, et al., (1998) *EMBO J.* 17:918-926; Southworth, et al., (1999) *Biotechniques* 27:110-120; Wood, et al., (1999) *Nat. Biotechnol.* 17:889-892; Wu, et al., (1998a) *Proc. Natl. Acad. Sci. USA* 95:9226-9231; Wu, et al., (1998b) *Biochim Biophys Acta* 1387:422-432; Xu, et al., (1999) *Proc. Natl. Acad. Sci. USA* 96:388-393; Yamazaki, et al., (1998) *J. Am. Chem. Soc.,* 120:5591-5592). For the application of inteins in plant transgenes, see, Yang, et al., (*Transgene Res* 15:583-593 (2006)) and Evans, et al., (*Annu. Rev. Plant Biol.* 56:375-392 (2005)).

In another aspect the PtIP-83 polypeptide may be encoded by two separate genes where the intein of the precursor protein comes from the two genes, referred to as a split-intein, and the two portions of the precursor are joined by a peptide bond formation. This peptide bond formation is accomplished by intein-mediated trans-splicing. For this purpose, a first and a second expression cassette comprising the two separate genes further code for inteins capable of mediating protein trans-splicing. By trans-splicing, the proteins and polypeptides encoded by the first and second fragments may be linked by peptide bond formation. Trans-splicing inteins may be selected from the nucleolar and organellar genomes of different organisms including eukaryotes, archaebacteria and eubacteria. Inteins that may be used for are listed at neb.com/neb/inteins.html, which can be accessed on the world-wide web using the "www" prefix). The nucleotide sequence coding for an intein may be split into a 5' and a 3' part that code for the 5' and the 3' part of the intein, respectively. Sequence portions not necessary for intein splicing (e.g. homing endonuclease domain) may be deleted. The intein coding sequence is split such that the 5' and the 3' parts are capable of trans-splicing. For selecting a suitable splitting site of the intein coding sequence, the considerations published by Southworth, et al., (1998) *EMBO J.* 17:918-926 may be followed. In constructing the first and the second expression cassette, the 5' intein coding sequence is linked to the 3' end of the first fragment coding for the N-terminal part of the PtIP-83 polypeptide and the 3' intein coding sequence is linked to the 5' end of the second fragment coding for the C-terminal part of the PtIP-83 polypeptide.

In general, the trans-splicing partners can be designed using any split intein, including any naturally-occurring or artificially-split split intein. Several naturally-occurring split inteins are known, for example: the split intein of the DnaE gene of *Synechocystis* sp. PCC6803 (see, Wu, et al., (1998) *Proc Natl Acad Sci USA.* 95(16):9226-31 and Evans, et al., (2000) *J Biol Chem.* 275(13):9091-4 and of the DnaE gene from *Nostoc punctiforme* (see, Iwai, et al., (2006) *FEBS Lett.* 580(7):1853-8). Non-split inteins have been artificially split in the laboratory to create new split inteins, for example: the artificially split Ssp DnaB intein (see, Wu, et al., (1998) *Biochim Biophys Acta.* 1387:422-32) and split Sce VMA intein (see, Brenzel, et al., (2006) *Biochemistry.* 45(6):1571-8) and an artificially split fungal mini-intein (see, Elleuche, et al., (2007) *Biochem Biophys Res Commun.* 355(3):830-4). There are also intein databases available that catalogue known inteins (see for example the online-database available at: bioinformatics.weizmann.ac.il/~pietro/inteins/Inteinstable.html, which can be accessed on the world-wide web using the "www" prefix).

Naturally-occurring non-split inteins may have endonuclease or other enzymatic activities that can typically be removed when designing an artificially-split split intein. Such mini-inteins or minimized split inteins are well known in the art and are typically less than 200 amino acid residues long (see, Wu, et al., (1998) *Biochim Biophys Acta.* 1387: 422-32). Suitable split inteins may have other purification enabling polypeptide elements added to their structure, provided that such elements do not inhibit the splicing of the split intein or are added in a manner that allows them to be removed prior to splicing. Protein splicing has been reported using proteins that comprise bacterial intein-like (BIL) domains (see, Amitai, et al., (2003) *Mol Microbiol.* 47:61-73) and hedgehog (Hog) auto-processing domains (the latter is combined with inteins when referred to as the Hog/intein superfamily or HINT family (see, Dassa, et al., (2004) *J Biol Chem.* 279:32001-7) and domains such as these may also be used to prepare artificially-split inteins. In particular, non-splicing members of such families may be modified by molecular biology methodologies to introduce or restore splicing activity in such related species. Recent studies demonstrate that splicing can be observed when a N-terminal split intein component is allowed to react with a C-terminal split intein component not found in nature to be its "partner"; for example, splicing has been observed utilizing partners that have as little as 30 to 50% homology with the "natural" splicing partner (see, Dassa, et al., (2007) *Biochemistry.* 46(1):322-30). Other such mixtures of disparate split intein partners have been shown to be unreactive one with another (see, Brenzel, et al., (2006) *Biochemistry.* 45(6):1571-8). However, it is within the ability of a person skilled in the relevant art to determine whether a particular pair of polypeptides is able to associate with each other to provide a functional intein, using routine methods and without the exercise of inventive skill.

In another aspect the PtIP-83 polypeptide is a circular permuted variant. In certain embodiments the PtIP-83 polypeptide is a circular permuted variant of the polypeptide of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769.

The development of recombinant DNA methods has made it possible to study the effects of sequence transposition on protein folding, structure and function. The approach used in creating new sequences resembles that of naturally occurring pairs of proteins that are related by linear reorganization of their amino acid sequences (Cunningham, et al., (1979) *Proc. Natl. Acad. Sci. U.S.A.* 76:3218-3222; Teather and Erfle, (1990) *J. Bacteriol.* 172:3837-3841; Schimming, et al., (1992) *Eur. J. Biochem.* 204:13-19; Yamiuchi and Minamikawa, (1991) *FEBS Lett.* 260:127-130; MacGregor, et al., (1996) *FEBS Lett.* 378:263-266). The first in vitro application of this type of rearrangement to proteins was described by Goldenberg and Creighton (*J. Mol. Biol.* 165:407-413, 1983). In creating a circular permuted variant a new N-terminus is selected at an internal site (breakpoint) of the original sequence, the new sequence having the same order of amino acids as the original from the breakpoint until it reaches an amino acid that is at or near the original C-terminus. At this point the new sequence is joined, either directly or through an additional portion of sequence (linker), to an amino acid that is at or near the original N-terminus and the new sequence continues with the same sequence as the original until it reaches a point that is at or near the amino acid that was N-terminal to the breakpoint site of the original sequence, this residue forming the new C-terminus of the chain. The length of the amino acid sequence of the linker can be selected empirically or with guidance from structural information or by using a combination of the two approaches. When no structural information is available, a small series of linkers can be prepared for testing using a design whose length is varied in order to span a range from 0 to 50 Å and whose sequence is chosen in order to be consistent with surface exposure (hydrophilicity, Hopp and Woods, (1983) *Mol. Immunol.* 20:483-489; Kyte and Doolittle, (1982) *J. Mol. Biol.* 157:105-132; solvent exposed surface area, Lee and Richards, (1971) *J. Mol. Biol.* 55:379-400) and the ability to adopt the necessary conformation without deranging the configuration of the pesticidal polypeptide (conformationally flexible; Karplus and Schulz, (1985) *Naturwissenschaften* 72:212-213). Assuming an average of translation of 2.0 to 3.8 Å per residue, this would mean the length to test would be between 0 to 30 residues, with 0 to 15 residues being the preferred range. Exemplary of such an empirical series would be to construct linkers using a cassette sequence such as Gly-Gly-Gly-Ser repeated n times, where n is 1, 2, 3 or 4. Those skilled in the art will recognize that there are many such sequences that vary in length or composition that can serve as linkers with the primary consideration being that they be neither excessively long nor short (cf., Sandhu, (1992) *Critical Rev. Biotech.* 12:437-462); if they are too long, entropy effects will likely destabilize the three-dimensional fold, and may also make folding kinetically impractical, and if they are too short, they will likely destabilize the molecule because of torsional or steric strain. Those skilled in the analysis of protein structural information will recognize that using the distance between the chain ends, defined as the distance between the c-alpha carbons, can be used to define the length of the sequence to be used or at least to limit the number of possibilities that must be tested in an empirical selection of linkers. They will also recognize that it is sometimes the case that the positions of the ends of the polypeptide chain are ill-defined in structural models derived from x-ray diffraction or nuclear magnetic resonance spectroscopy data, and that when true, this situation will therefore need to be taken into account in order to properly estimate the length of the linker required. From those residues whose positions are well defined are selected two residues that are close in sequence to the chain ends, and the distance between their c-alpha carbons is used to calculate an approximate length for a linker between them. Using the calculated length as a guide, linkers with a range of number of residues (calculated using 2 to 3.8 Å per residue) are then selected. These linkers may be composed of the original sequence, shortened or lengthened as necessary, and when lengthened the additional residues may be chosen to be flexible and hydrophilic as described above; or optionally the original sequence may be substituted for using a series of linkers, one example being the Gly-Gly-Gly-Ser cassette approach mentioned above; or optionally a combination of the original sequence and new sequence having the appropriate total length may be used. Sequences of pesticidal polypeptides capable of folding to biologically active states can be prepared by appropriate selection of the beginning (amino terminus) and ending (carboxyl terminus) positions from within the original polypeptide chain while using the linker sequence as described above. Amino and carboxyl termini are selected from within a common stretch of sequence, referred to as a breakpoint region, using the guidelines described below. A novel amino acid sequence is thus generated by selecting amino and carboxyl termini from within the same breakpoint region. In many cases the selection of the new termini will be such that the original position of the carboxyl terminus immediately preceded that of the amino terminus. However, those skilled in the art will recognize that selections of termini anywhere within the region may function, and that these will effectively lead to either deletions or additions to the amino or carboxyl portions of the new sequence. It is a central tenet of molecular biology that the primary amino acid sequence of a protein dictates folding to the three-dimensional structure necessary for expression of its biological function. Methods are known to those skilled in the art to obtain and interpret three-dimensional structural information using x-ray diffraction of single protein Crystals or nuclear magnetic resonance spectroscopy of protein solutions. Examples of structural information that are relevant to the identification of breakpoint regions include the location and type of protein secondary structure (alpha and 3-10 helices, parallel and anti-parallel beta sheets, chain reversals and turns, and loops; Kabsch and Sander, (1983) *Biopolymers* 22:2577-2637; the degree of solvent exposure of amino acid residues, the extent and type of interactions of residues with one another (Chothia, (1984) *Ann. Rev. Biochem.* 53:537-572) and the static and dynamic distribution of conformations along the polypeptide chain (Alber and Mathews, (1987) *Methods Enzymol.* 154:511-533). In some cases additional information is known about solvent exposure of residues; one example is a site of post-translational attachment of carbohydrate which is necessarily on the surface of the protein. When experimental structural information is not available or is not feasible to obtain, methods are also available to analyze the primary amino acid sequence in order to make predictions of protein tertiary and secondary structure, solvent accessibility and the occurrence of turns and loops. Biochemical methods are also sometimes applicable for empirically determining surface exposure when direct structural methods are not feasible; for example, using the identification of sites of chain scission following limited proteolysis in order to infer surface exposure (Gentile and Salvatore, (1993) *Eur. J. Biochem.* 218:603-621). Thus using either the experimentally derived structural information or predictive methods (e.g., Srinivisan and Rose, (1995) *Proteins: Struct., Funct. & Genetics* 22:81-99) the parental amino acid sequence is inspected to classify regions according to whether or not they are integral to the maintenance of secondary and tertiary structure. The occurrence of sequences within regions that are known to be involved in periodic secondary structure (alpha and 3-10 helices, parallel and anti-parallel beta sheets) are regions that should be avoided. Similarly, regions of amino acid sequence that are observed or PtIP- to have a low degree of solvent exposure are more likely to be part of the so-called hydrophobic core of the protein and should also be avoided for selection of amino and carboxyl termini. In contrast, those regions that are known or PtIP- to be in surface turns or loops, and especially those regions that are known not to be required for biological activity, are the preferred sites for location of the extremes of the polypeptide chain. Continuous stretches of amino acid sequence that are preferred based on the above criteria are referred to as a breakpoint region. Polynucleotides encoding circular permuted PtIP-83 polypeptides with new N-terminus/C-terminus which contain a linker region separating the original C-terminus and N-terminus can be made essentially following the method described in Mullins, et al., (1994) *J. Am. Chem. Soc.* 116:5529-5533. Multiple steps of polymerase chain reaction (PCR) amplifications are used to rearrange the DNA sequence encoding the primary amino acid sequence of the protein. Polynucleotides encoding circular permuted PtIP-83 polypeptides with new N-terminus/C-terminus which contain a linker region separating the original C-terminus and N-terminus can be made based on the tandem-duplication method described in Horlick, et al., (1992) *Protein Eng.* 5:427-431. Polymerase chain reaction (PCR) amplification of the new N-terminus/C-terminus genes is performed using a tandemly duplicated template DNA.

In another aspect fusion proteins are provided that include within its amino acid sequence an amino acid sequence comprising a PtIP-83 polypeptide including but not limited to the polypeptide of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, SEQ ID NO: 769, and active fragments thereof.

Methods for design and construction of fusion proteins (and polynucleotides encoding same) are known to those of skill in the art. Polynucleotides encoding a PtIP-83 polypeptide may be fused to signal sequences which will direct the localization of the PtIP-83 polypeptide to particular compartments of a prokaryotic or eukaryotic cell and/or direct the secretion of the PtIP-83 polypeptide of the embodiments from a prokaryotic or eukaryotic cell. For example, in *E. coli*, one may wish to direct the expression of the protein to the periplasmic space. Examples of signal sequences or proteins (or fragments thereof) to which the PtIP-83 polypeptide may be fused in order to direct the expression of the polypeptide to the periplasmic space of bacteria include, but are not limited to, the pelB signal sequence, the maltose binding protein (MBP) signal sequence, MBP, the ompA signal sequence, the signal sequence of the periplasmic *E. coli* heat-labile enterotoxin B-subunit and the signal sequence of alkaline phosphatase. Several vectors are commercially available for the construction of fusion proteins which will direct the localization of a protein, such as the pMAL series of vectors (particularly the pMAL-p series) available from New England Biolabs. In a specific embodiment, the PtIP-83 polypeptide may be fused to the pelB pectate lyase signal sequence to increase the efficiency of expression and purification of such polypeptides in Gram-negative bacteria (see, U.S. Pat. Nos. 5,576,195 and 5,846,818). Plant plastid transit peptide/polypeptide fusions are well known in the art (see, U.S. Pat. No. 7,193,133). Apoplast transit peptides such as rice or barley alpha-amylase secretion signal are also well known in the art. The plastid transit peptide is generally fused N-terminal to the polypeptide to be targeted (e.g., the fusion partner). In one embodiment, the fusion protein consists essentially of the plastid transit peptide and the PtIP-83 polypeptide to be targeted. In another embodiment, the fusion protein comprises the plastid transit peptide and the polypeptide to be targeted. In such embodiments, the plastid transit peptide is preferably at the N-terminus of the fusion protein. However, additional amino acid residues may be N-terminal to the plastid transit peptide providing that the fusion protein is at least partially targeted to a plastid. In a specific embodiment, the plastid transit peptide is in the N-terminal half, N-terminal third or N-terminal quarter of the fusion protein. Most or all of the plastid transit peptide is generally cleaved from the fusion protein upon insertion into the plastid. The position of cleavage may vary slightly between plant species, at different plant developmental stages, as a result of specific intercellular conditions or the particular combination of transit peptide/fusion partner used. In one embodiment, the plastid transit peptide cleavage is homogenous such that the cleavage site is identical in a population of fusion proteins. In another embodiment, the plastid transit peptide is not homogenous, such that the cleavage site varies by 1-10 amino acids in a population of fusion proteins. The plastid transit peptide can be recombinantly fused to a second protein in one of several ways. For example, a restriction endonuclease recognition site can be introduced into the nucleotide sequence of the transit peptide at a position corresponding to its C-terminal end and the same or a compatible site can be engineered into the nucleotide sequence of the protein to be targeted at its N-terminal end. Care must be taken in designing these sites to ensure that the coding sequences of the transit peptide and the second protein are kept "in frame" to allow the synthesis of the desired fusion protein. In some cases, it may be preferable to remove the initiator methionine codon of the second protein when the new restriction site is introduced. The introduction of restriction endonuclease recognition sites on both parent molecules and their subsequent joining through recombinant DNA techniques may result in the addition of one or more extra amino acids between the transit peptide and the second protein. This generally does not affect targeting activity as long as the transit peptide cleavage site remains accessible and the function of the second protein is not altered by the addition of these extra amino acids at its N-terminus. Alternatively, one skilled in the art can create a precise cleavage site between the transit peptide and the second protein (with or without its initiator methionine) using gene synthesis (Stemmer, et al., (1995) *Gene* 164:49-53) or similar methods. In addition, the transit peptide fusion can intentionally include amino acids downstream of the cleavage site. The amino acids at the N-terminus of the mature protein can affect the ability of the transit peptide to target proteins to plastids and/or the efficiency of cleavage following protein import. This may be dependent on the protein to be targeted. See, e.g., Comai, et al., (1988) *J. Biol. Chem.* 263(29):15104-9.

In some embodiments fusion proteins are provide comprising a PtIP-83 polypeptide and an insecticidal polypeptide joined by an amino acid linker. In some embodiments fusion proteins are provided represented by a formula selected from the group consisting of:

$R^1$-L-$R^2$, $R^2$-L-$R^1$, $R^1$-$R^2$ or $R^2$-$R^1$ wherein $R^1$ is a PtIP-83 polypeptide, $R^2$ is a protein of interest. The $R^1$ polypeptide is fused either directly or through a linker (L) segment to the $R^2$ polypeptide. The term "directly" defines fusions in which the polypeptides are joined without a peptide linker. Thus "L" represents a chemical bound or polypeptide segment to which both $R^1$ and $R^2$ are fused in frame, most commonly L is a linear peptide to which $R^1$ and $R^2$ are bound by amide bonds linking the carboxy terminus of $R^1$ to the amino terminus of L and carboxy terminus of L to the amino terminus of $R^2$. By "fused in frame" is meant that there is no translation termination or disruption between the reading frames of $R^1$ and $R^2$. The linking group (L) is generally a polypeptide of between 1 and 500 amino acids in length. The linkers joining the two molecules are preferably designed to (1) allow the two molecules to fold and act independently of each other, (2) not have a propensity for developing an ordered secondary structure which could interfere with the functional domains of the two proteins, (3) have minimal hydrophobic or charged characteristic which could interact with the functional protein domains and (4) provide steric separation of $R^1$ and $R^2$ such that $R^1$ and $R^2$ could interact simultaneously with their corresponding receptors on a single cell. Typically surface amino acids in flexible protein regions include Gly, Asn and Ser. Virtually any permutation of amino acid sequences containing Gly, Asn and Ser would be expected to satisfy the above criteria for a linker sequence. Other neutral amino acids, such as Thr and Ala, may also be used in the linker sequence. Additional amino acids may also be included in the linkers due to the addition of unique restriction sites in the linker sequence to facilitate construction of the fusions.

In some embodiments the linkers comprise sequences selected from the group of formulas: $(Gly_3Ser)_n$, $(Gly_4Ser)_n$, $(Gly_5Ser)_n$, $(Gly_nSer)_n$ or $(AlaGlySer)_n$ where n is an integer. One example of a highly-flexible linker is the (GlySer)-rich spacer region present within the pill protein of the filamentous bacteriophages, e.g. bacteriophages M13 or fd (Schaller, et al., 1975). This region provides a long, flexible spacer region between two domains of the pill surface protein. Also included are linkers in which an endopeptidase recognition sequence is included. Such a cleavage site may be valuable to separate the individual components of the fusion to determine if they are properly folded and active in vitro. Examples of various endopeptidases include, but are not limited to, Plasmin, Enterokinase, Kallikerin, Urokinase, Tissue Plasminogen activator, clostripain, Chymosin, Collagenase, Russell's Viper Venom Protease, Postproline cleavage enzyme, V8 protease, Thrombin and factor Xa. In some embodiments the linker comprises the amino acids EEKKN (SEQ ID NO: 37) from the multi-gene expression vehicle (MGEV), which is cleaved by vacuolar proteases as disclosed in US Patent Application Publication Number US 2007/0277263. In other embodiments, peptide linker segments from the hinge region of heavy chain immunoglobulins IgG, IgA, IgM, IgD or IgE provide an angular relationship between the attached polypeptides. Especially useful are those hinge regions where the cysteines are replaced with serines. Linkers of the present disclosure include sequences derived from murine IgG gamma 2b hinge region in which the cysteines have been changed to serines. The fusion proteins are not limited by the form, size or number of linker sequences employed and the only requirement of the linker is that functionally it does not interfere adversely with the folding and function of the individual molecules of the fusion.

In another aspect chimeric PtIP-83 polypeptides are provided that are created through joining two or more portions of PtIP-83 genes, which originally encoded separate PtIP-83 proteins to create a chimeric gene. The translation of the chimeric gene results in a single chimeric PtIP-83 polypeptide with regions, motifs or domains derived from each of the original polypeptides. In certain embodiments the chimeric protein comprises portions, motifs or domains of PtIP-83 polypeptides of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769, in any combination.

It is recognized that DNA sequences may be altered by various methods, and that these alterations may result in DNA sequences encoding proteins with amino acid sequences different than that encoded by the wild-type (or native) pesticidal protein. In some embodiments a PtIP-83 polypeptide may be altered in various ways including amino acid substitutions, deletions, truncations and insertions of one or more amino acids, including up to 2, 3, 4, 5, 6, 7, 8, 9, 10, 15, 20, 25, 30, 35, 40, 45, 50, 55, 60, 65, 70, 75, 80, 85, 90, 100, 105, 110, 115, 120, 125, 130, 135, 140, 145 or more amino acid substitutions, deletions and/or insertions or combinations thereof compared to any one of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769.

In some embodiments a PtIP-83 polypeptide variant comprises one or more amino acid substitution, of Table 13, Table 14, Table 15, Table 16, Table 17, Table 18, Table 20, Table 21, Table 23, Table 24 or combinations thereof, compared to the native amino acid of PtIP-83Aa (SEQ ID NO: 1) at the corresponding residue.

In some embodiments a PtIP-83 polypeptide variant is selected from but not limited to any one of SEQ ID NO: 236-299, SEQ ID NO: 334-367, SEQ ID NO: 398-427, SEQ ID NO: 518-607, and SEQ ID NO: 728-737.

In some embodiments a PtIP-83 polypeptide comprises a deletion of 1, 2, 3, 4, 5, 6, 7, 8, 9, 10, 11, 12, 13, 14, 15 or more amino acids from the N-terminus of the PtIP-83 polypeptide relative to the amino acid position of any one of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769.

In some embodiments a PtIP-83 polypeptide comprises a deletion of 1, 2, 3, 4, 5, 6, 7, 8, 9, 10, 11, 12, 13, 14, 15 or more amino acids from the C-terminus of the PtIP-83 polypeptide relative to the amino acid position of any one of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769.

Methods for such manipulations are generally known in the art. For example, amino acid sequence variants of a PtIP-83 polypeptide can be prepared by mutations in the DNA. This may also be accomplished by one of several forms of mutagenesis and/or in directed evolution. In some aspects, the changes encoded in the amino acid sequence will not substantially affect the function of the protein. Such variants will possess the desired pesticidal activity. However, it is understood that the ability of a PtIP-83 polypeptide to confer pesticidal activity may be improved by the use of such techniques upon the compositions of this disclosure.

For example, conservative amino acid substitutions may be made at one or more, PtIP-, nonessential amino acid residues. A "nonessential" amino acid residue is a residue that can be altered from the wild-type sequence of a PtIP-83 without altering the biological activity. A "conservative amino acid substitution" is one in which the amino acid residue is replaced with an amino acid residue having a similar side chain. Families of amino acid residues having similar side chains have been defined in the art. These families include: amino acids with basic side chains (e.g., lysine, arginine, histidine); acidic side chains (e.g., aspartic acid, glutamic acid); polar, negatively charged residues and their amides (e.g., aspartic acid, asparagine, glutamic, acid, glutamine; uncharged polar side chains (e.g., glycine, asparagine, glutamine, serine, threonine, tyrosine, cysteine); small aliphatic, nonpolar or slightly polar residues (e.g., Alanine, serine, threonine, proline, glycine); nonpolar side chains (e.g., alanine, valine, leucine, isoleucine, proline, phenylalanine, methionine, tryptophan); large aliphatic, nonpolar residues (e.g., methionine, leucine, isoleucine, valine, cystine); beta-branched side chains (e.g., threonine, valine, isoleucine); aromatic side chains (e.g., tyrosine, phenylalanine, tryptophan, histidine); large aromatic side chains (e.g., tyrosine, phenylalanine, tryptophan).

Amino acid substitutions may be made in nonconserved regions that retain function. In general, such substitutions would not be made for conserved amino acid residues or for amino acid residues residing within a conserved motif, where such residues are essential for protein activity. Examples of residues that are conserved and that may be essential for protein activity include, for example, residues that are identical between all proteins contained in an alignment of similar or related toxins to the sequences of the embodiments (e.g., residues that are identical in an alignment of homologous proteins). Examples of residues that are conserved but that may allow conservative amino acid substitutions and still retain activity include, for example, residues that have only conservative substitutions between all proteins contained in an alignment of similar or related toxins to the sequences of the embodiments (e.g., residues that have only conservative substitutions between all proteins contained in the alignment homologous proteins). However, one of skill in the art would understand that functional variants may have minor conserved or nonconserved alterations in the conserved residues. Guidance as to appropriate amino acid substitutions that do not affect biological activity of the protein of interest may be found in the model of Dayhoff, et al., (1978) *Atlas of Protein Sequence and Structure* (Natl. Biomed. Res. Found., Washington, D.C.), herein incorporated by reference. In making such changes, the hydropathic index of amino acids may be considered. The importance of the hydropathic amino acid index in conferring interactive biologic function on a protein is generally understood in the art (Kyte and Doolittle, (1982) *J Mol Biol.* 157(1):105-32). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

It is known in the art that certain amino acids may be substituted by other amino acids having a similar hydropathic index or score and still result in a protein with similar biological activity, i.e., still obtain a biological functionally equivalent protein. Each amino acid has been assigned a hydropathic index on the basis of its hydrophobicity and charge characteristics (Kyte and Doolittle, ibid). These are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9) and arginine (−4.5). In making such changes, the substitution of amino acids whose hydropathic indices are within +2 is preferred, those which are within +1 are particularly preferred, and those within +0.5 are even more particularly preferred.

It is also understood in the art that the substitution of like amino acids can be made effectively on the basis of hydrophilicity. U.S. Pat. No. 4,554,101, states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0.+ 0.1); glutamate (+3.0.+0.1); serine (+0.3); asparagine (+0.2); glutamine (+0.2); glycine (0); threonine (−0.4); proline (−0.5.+0.1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4).

Alternatively, alterations may be made to the protein sequence of many proteins at the amino or carboxy terminus without substantially affecting activity. This can include insertions, deletions or alterations introduced by modern molecular methods, such as PCR, including PCR amplifications that alter or extend the protein coding sequence by virtue of inclusion of amino acid encoding sequences in the oligonucleotides utilized in the PCR amplification. Alternatively, the protein sequences added can include entire protein-coding sequences, such as those used commonly in the art to generate protein fusions. Such fusion proteins are often used to (1) increase expression of a protein of interest (2) introduce a binding domain, enzymatic activity or epitope to facilitate either protein purification, protein detection or other experimental uses known in the art (3) target secretion or translation of a protein to a subcellular organelle, such as the periplasmic space of Gram-negative bacteria, mitochondria or chloroplasts of plants or the endoplasmic reticulum of eukaryotic cells, the latter of which often results in glycosylation of the protein.

Variant nucleotide and amino acid sequences of the disclosure also encompass sequences derived from mutagenic and recombinogenic procedures such as DNA shuffling. With such a procedure, one or more different PtIP-83 polypeptide coding regions can be used to create a new PtIP-83 polypeptide possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between a pesticidal gene and other known pesticidal genes to obtain a new gene coding for a protein with an improved property of interest, such as an increased insecticidal activity. Strategies for such DNA shuffling are known in the art. See, for example, Stemmer, (1994) *Proc. Natl. Acad. Sci. USA* 91:10747-10751; Stemmer, (1994) *Nature* 370:389-391; Crameri, et al., (1997) *Nature Biotech.* 15:436-438; Moore, et al., (1997) *J. Mol. Biol.* 272:336-347; Zhang, et al., (1997) *Proc. Natl. Acad. Sci. USA* 94:4504-4509; Crameri, et al., (1998) *Nature* 391:288-291; and U.S. Pat. Nos. 5,605,793 and 5,837,458.

Domain swapping or shuffling is another mechanism for generating altered PtIP-83 polypeptides. Domains may be swapped between PtIP-83 polypeptides resulting in hybrid or chimeric toxins with improved insecticidal activity or target spectrum. Methods for generating recombinant proteins and testing them for pesticidal activity are well known in the art (see, for example, Naimov, et al., (2001) *Appl. Environ. Microbiol.* 67:5328-5330; de Maagd, et al., (1996) *Appl. Environ. Microbiol.* 62:1537-1543; Ge, et al., (1991) *J. Biol. Chem.* 266:17954-17958; Schnepf, et al., (1990) *J. Biol. Chem.* 265:20923-20930; Rang, et al., 91999) *Appl. Environ. Microbiol.* 65:2918-2925).

Alignment of PtIP-83 homologs (FIG. 2) allows for identification of residues that are highly conserved among natural homologs in this family.

In some embodiments PtIP-83 polypeptides are provided comprising an amino acid sequence having at least 80%, at least 85%, at least 90%, at least 95%, at least 96%, at least 97%, at least 98% or at least 99% sequence identity to any one of SEQ ID NO: 786-888.

In some embodiments PtIP-83 polypeptides are provide comprising the amino acid sequence of any one of SEQ ID NO: 786-888.

In some embodiments the PtIP-83 polypeptide is not the amino acid sequence of any one of SEQ ID NO: 786-888.
Compositions Compositions comprising a PtIP-83 polypeptide of the disclosure are also embraced. In some embodiments the composition comprises a PtIP-83 polypeptide of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769 or a variant thereof. In some embodiments the composition comprises a PtIP-83 fusion protein.

In some embodiments compositions are provided comprising a PtIP-83 polypeptide comprising an amino acid sequence of any one of SEQ ID NO: 236-299, SEQ ID NO: 334-367, SEQ ID NO: 398-427, SEQ ID NO: 518-607, SEQ ID NO: 640-645, and SEQ ID NO: 728-737 or a variant thereof.

In some embodiments compositions are provide comprising a PtIP-83 polypeptide comprising the amino acid sequence of any one of SEQ ID NO: 786-888 or a variant thereof.

In some embodiments agricultural compositions of PtIP-83 polypeptides are disclosed. In the embodiments, a transformed microorganism (which includes whole organisms, cells, spore(s), PtIP-83 polypeptide(s), pesticidal component(s), pest-impacting component(s), variant(s), living or dead cells and cell components, including mixtures of living and dead cells and cell components, and including broken cells and cell components) or an isolated PtIP-83 polypeptide(s) can be formulated with an acceptable carrier into a pesticidal composition(s) that is, for example, a suspension, a solution, an emulsion, a dusting powder, a dispersible granule or pellet, a wettable powder, and an emulsifiable concentrate, an aerosol or spray, an impregnated granule, an adjuvant, a coatable paste, a colloid, and also encapsulations in, for example, polymer substances. Such formulated compositions may be prepared by such conventional means as desiccation, lyophilization, homogenization, extraction, filtration, centrifugation, sedimentation, or concentration of a culture of cells comprising the polypeptide.

Such compositions disclosed above may be obtained by the addition of a surface-active agent, an inert carrier, a preservative, a humectant, a feeding stimulant, an attractant, an encapsulating agent, a binder, an emulsifier, a dye, a UV protectant, a buffer, a flow agent or fertilizers, micronutrient donors, or other preparations that influence plant growth. One or more agrochemicals including, but not limited to, herbicides, insecticides, fungicides, bactericides, nematocides, molluscicides, acaricides, plant growth regulators, harvest aids, and fertilizers, can be combined with carriers, surfactants or adjuvants customarily employed in the art of formulation or other components to facilitate product handling and application for particular target pests. Suitable carriers and adjuvants can be solid or liquid and correspond to the substances ordinarily employed in formulation technology, e.g., natural or regenerated mineral substances, solvents, dispersants, wetting agents, tackifiers, binders, or fertilizers. The active ingredients of the embodiments are normally applied in the form of compositions and can be applied to the crop area, plant, or seed to be treated. For example, the compositions of the embodiments may be applied to grain in preparation for or during storage in a grain bin or silo, etc. The compositions of the embodiments may be applied simultaneously or in succession with other compounds. Methods of applying an active ingredient of the embodiments or an agrochemical composition of the embodiments that contains at least one of the Cyt1A variant polypeptides produced by the bacterial strains of the embodiments include, but are not limited to, foliar application, seed coating, and soil application. The number of applications and the rate of application depend on the intensity of infestation by the corresponding pest.

Suitable surface-active agents include, but are not limited to, anionic compounds such as a carboxylate of, for example, a metal; a carboxylate of a long chain fatty acid; an N-acylsarcosinate; mono or di-esters of phosphoric acid with fatty alcohol ethoxylates or salts of such esters; fatty alcohol sulfates such as sodium dodecyl sulfate, sodium octadecyl sulfate or sodium cetyl sulfate; ethoxylated fatty alcohol sulfates; ethoxylated alkylphenol sulfates; lignin sulfonates; petroleum sulfonates; alkyl aryl sulfonates such as alkyl-benzene sulfonates or lower alkylnaphtalene sulfonates, e.g., butyl-naphthalene sulfonate; salts of sulfonated naphthalene-formaldehyde condensates; salts of sulfonated phenol-formaldehyde condensates; more complex sulfonates such as the amide sulfonates, e.g., the sulfonated condensation product of oleic acid and N-methyl taurine; or the dialkyl sulfosuccinates, e.g., the sodium sulfonate of dioctyl succinate. Non-ionic agents include condensation products of fatty acid esters, fatty alcohols, fatty acid amides or fatty-alkyl- or alkenyl-substituted phenols with ethylene oxide, fatty esters of polyhydric alcohol ethers, e.g., sorbitan fatty acid esters, condensation products of such esters with ethylene oxide, e.g., polyoxyethylene sorbitar fatty acid esters, block copolymers of ethylene oxide and propylene oxide, acetylenic glycols such as 2,4,7,9-tetraethyl-5-decyn-4,7-diol, or ethoxylated acetylenic glycols. Examples of a cationic surface-active agent include, for instance, an aliphatic mono-, di-, or polyamine such as an acetate, naphthenate or oleate; or oxygen-containing amine such as an amine oxide of polyoxyethylene alkylamine; an amide-linked amine prepared by the condensation of a carboxylic acid with a di- or polyamine; or a quaternary ammonium salt.

Examples of inert materials include but are not limited to inorganic minerals such as kaolin, phyllosilicates, carbonates, sulfates, phosphates, Mica, Amorphous Silica Gel, talc, clay, volcanic ash or botanical materials such as cork, powdered corncobs, peanut hulls, rice hulls, and walnut shells. Kaolins such as kaolinite, dickite, nacrite, anauxite, halloysite and endellite are useful as carrier materials. Montmorillonites, such as beidellite, nontronite, montmorillonite, hectorite, saponite, sauconite and bentonite are useful as carrier materials. Vermiculites such as biotite are useful as carrier materials.

The compositions of the embodiments can be in a suitable form for direct application or as a concentrate of primary composition that requires dilution with a suitable quantity of water or other diluent before application. The pesticidal concentration will vary depending upon the nature of the particular formulation, specifically, whether it is a concentrate or to be used directly. The composition contains 1 to 98% of a solid or liquid inert carrier, and 0 to 50% or 0.1 to 50% of a surfactant. These compositions will be administered at the labeled rate for the commercial product, for example, about 0.01 lb-5.0 lb. per acre when in dry form and at about 0.01 pts.-10 pts. per acre when in liquid form.

Antibodies

Antibodies to a PtIP-83 polypeptide of the embodiments or to variants or fragments thereof are also encompassed. The antibodies of the disclosure include polyclonal and monoclonal antibodies as well as fragments thereof which retain their ability to bind to PtIP-83 polypeptide found in the insect gut. An antibody, monoclonal antibody or fragment thereof is said to be capable of binding a molecule if it is capable of specifically reacting with the molecule to thereby bind the molecule to the antibody, monoclonal antibody or fragment thereof. The term "antibody" (Ab) or "monoclonal antibody" (Mab) is meant to include intact molecules as well as fragments or binding regions or domains thereof (such as, for example, Fab and F(ab).sub.2 fragments) which are capable of binding hapten. Such fragments are typically produced by proteolytic cleavage, such as papain or pepsin. Alternatively, hapten-binding fragments can be produced through the application of recombinant DNA technology or through synthetic chemistry. Methods for the preparation of the antibodies of the present disclosure are generally known in the art. For example, see, Antibodies, A Laboratory Manual, Ed Harlow and David Lane (eds.) Cold Spring Harbor Laboratory, N.Y. (1988), as well as the references cited therein. Standard reference works setting forth the general principles of immunology include: Klein, J. Immunology: The Science of Cell-Noncell Discrimination, John Wiley & Sons, N.Y. (1982); Dennett, et al., Monoclonal Antibodies, Hybridoma: A New Dimension in Biological Analyses, Plenum Press, N.Y. (1980) and Campbell, "Monoclonal Antibody Technology," In Laboratory Techniques in Biochemistry and Molecular Biology, Vol. 13, Burdon, et al., (eds.), Elsevier, Amsterdam (1984). See also, U.S. Pat. Nos. 4,196,265; 4,609,893; 4,713,325; 4,714,681; 4,716,111; 4,716,117 and 4,720,459. PtIP-83 polypeptide antibodies or antigen-binding portions thereof can be produced by a variety of techniques, including conventional monoclonal antibody methodology, for example the standard somatic cell hybridization technique of Kohler and Milstein, (1975) Nature 256:495. Other techniques for producing monoclonal antibody can also be employed such as viral or oncogenic transformation of B lymphocytes. An animal system for preparing hybridomas is a murine system. Immunization protocols and techniques for isolation of immunized splenocytes for fusion are known in the art. Fusion partners (e.g., murine myeloma cells) and fusion procedures are also known. The antibody and monoclonal antibodies of the disclosure can be prepared by utilizing a PtIP-83 polypeptide as antigens.

A kit for detecting the presence of a PtIP-83 polypeptide or detecting the presence of a nucleotide sequence encoding a PtIP-83 polypeptide in a sample is provided. In one embodiment, the kit provides antibody-based reagents for detecting the presence of a PtIP-83 polypeptide in a tissue sample. In another embodiment, the kit provides labeled nucleic acid probes useful for detecting the presence of one or more polynucleotides encoding PtIP-83 polypeptide. The kit is provided along with appropriate reagents and controls for carrying out a detection method, as well as instructions for use of the kit.

Receptor Identification and Isolation

Receptors to the PtIP-83 polypeptide of the embodiments or to variants or fragments thereof, are also encompassed. Methods for identifying receptors are well known in the art (see, Hofmann, et. al., (1988) Eur. J. Biochem. 173:85-91; Gill, et al., (1995) J. Biol. Chem. 27277-27282) can be employed to identify and isolate the receptor that recognizes the PtIP-83 polypeptide using the brush-border membrane vesicles from susceptible insects. In addition to the radioactive labeling method listed in the cited literatures, PtIP-83 polypeptide can be labeled with fluorescent dye and other common labels such as streptavidin. Brush-border membrane vesicles (BBMV) of susceptible insects such as soybean looper and stink bugs can be prepared according to the protocols listed in the references and separated on SDS-PAGE gel and blotted on suitable membrane. Labeled PtIP-83 polypeptide can be incubated with blotted membrane of BBMV and labeled the PtIP-83 polypeptide can be identified with the labeled reporters. Identification of protein band(s) that interact with the PtIP-83 polypeptide can be detected by N-terminal amino acid gas phase sequencing or mass spectrometry based protein identification method (Patterson, (1998) 10.22, 1-24, Current Protocol in Molecular Biology published by John Wiley & Son Inc). Once the protein is identified, the corresponding gene can be cloned from genomic DNA or cDNA library of the susceptible insects and binding affinity can be measured directly with the PtIP-83 polypeptide. Receptor function for insecticidal activity by the PtIP-83 polypeptide can be verified by accomplished by RNAi type of gene knock out method (Rajagopal, et al., (2002) J. Biol. Chem. 277:46849-46851).

Nucleotide Constructs, Expression Cassettes and Vectors

The use of the term "nucleotide constructs" herein is not intended to limit the embodiments to nucleotide constructs comprising DNA. Those of ordinary skill in the art will recognize that nucleotide constructs particularly polynucleotides and oligonucleotides composed of ribonucleotides and combinations of ribonucleotides and deoxyribonucleotides may also be employed in the methods disclosed herein. The nucleotide constructs, nucleic acids, and nucleotide sequences of the embodiments additionally encompass all complementary forms of such constructs, molecules, and sequences. Further, the nucleotide constructs, nucleotide molecules, and nucleotide sequences of the embodiments encompass all nucleotide constructs, molecules, and sequences which can be employed in the methods of the embodiments for transforming plants including, but not limited to, those comprised of deoxyribonucleotides, ribonucleotides, and combinations thereof. Such deoxyribonucleotides and ribonucleotides include both naturally occurring molecules and synthetic analogues. The nucleotide constructs, nucleic acids, and nucleotide sequences of the embodiments also encompass all forms of nucleotide constructs including, but not limited to, single-stranded forms, double-stranded forms, hairpins, stem-and-loop structures and the like.

A further embodiment relates to a transformed organism such as an organism selected from plant and insect cells, bacteria, yeast, baculovirus, protozoa, nematodes and algae. The transformed organism comprises a DNA molecule of the embodiments, an expression cassette comprising the DNA molecule or a vector comprising the expression cassette, which may be stably incorporated into the genome of the transformed organism.

In some embodiments transgenic host cells are provide transformed with a polynucleotide encoding a PtIP-83 polypeptide of the disclosure. In some embodiments the host cell is a plant cell. In some embodiments the host cell is a bacteria.

The sequences of the embodiments are provided in DNA constructs for expression in the organism of interest. The construct will include 5' and 3' regulatory sequences operably linked to a sequence of the embodiments. The term "operably linked" as used herein refers to a functional linkage between a promoter and a second sequence, wherein the promoter sequence initiates and mediates transcription of the DNA sequence corresponding to the second sequence. Generally, operably linked means that the nucleic acid sequences being linked are contiguous and where necessary to join two protein coding regions in the same reading frame. The construct may additionally contain at least one additional gene to be cotransformed into the organism. Alternatively, the additional gene(s) can be provided on multiple DNA constructs.

Such a DNA construct is provided with a plurality of restriction sites for insertion of the PtIP-83 polypeptide gene sequence to be under the transcriptional regulation of the regulatory regions. The DNA construct may additionally contain selectable marker genes. The DNA construct will generally include in the 5' to 3' direction of transcription: a transcriptional and translational initiation region (i.e., a promoter), a DNA sequence of the embodiments, and a transcriptional and translational termination region (i.e., termination region) functional in the organism serving as a host. The transcriptional initiation region (i.e., the promoter) may be native, analogous, foreign or heterologous to the host organism and/or to the sequence of the embodiments. Additionally, the promoter may be the natural sequence or alternatively a synthetic sequence. The term "foreign" as used herein indicates that the promoter is not found in the native organism into which the promoter is introduced. Where the promoter is "foreign" or "heterologous" to the sequence of the embodiments, it is intended that the promoter is not the native or naturally occurring promoter for the operably linked sequence of the embodiments. As used herein, a chimeric gene comprises a coding sequence operably linked to a transcription initiation region that is heterologous to the coding sequence. Where the promoter is a native or natural sequence, the expression of the operably linked sequence is altered from the wild-type expression, which results in an alteration in phenotype.

In some embodiments the DNA construct may also include a transcriptional enhancer sequence. As used herein, the term an "enhancer" refers to a DNA sequence which can stimulate promoter activity, and may be an innate element of the promoter or a heterologous element inserted to enhance the level or tissue-specificity of a promoter. Various enhancers are known in the art including for example, introns with gene expression enhancing properties in plants (US Patent Application Publication Number 2009/0144863, the ubiquitin intron (i.e., the maize ubiquitin intron 1 (see, for example, NCBI sequence S94464)), the omega enhancer or the omega prime enhancer (Gallie, et al., (1989) *Molecular Biology of RNA* ed. Cech (Liss, New York) 237-256 and Gallie, et al., (1987) *Gene* 60:217-25), the CaMV 35S enhancer (see, e.g., Benfey, et al., (1990) *EMBO J.* 9:1685-96) and the enhancers of U.S. Pat. No. 7,803,992 may also be used, each of which is incorporated by reference. The above list of transcriptional enhancers is not meant to be limiting. Any appropriate transcriptional enhancer can be used in the embodiments.

The termination region may be native with the transcriptional initiation region, may be native with the operably linked DNA sequence of interest, may be native with the plant host or may be derived from another source (i.e., foreign or heterologous to the promoter, the sequence of interest, the plant host or any combination thereof).

Convenient termination regions are available from the Ti-plasmid of *A. tumefaciens*, such as the octopine synthase and nopaline synthase termination regions. See also, Guerineau, et al., (1991) *Mol. Gen. Genet.* 262:141-144; Proudfoot, (1991) *Cell* 64:671-674; Sanfacon, et al., (1991) *Genes Dev.* 5:141-149; Mogen, et al., (1990) *Plant Cell* 2:1261-1272; Munroe, et al., (1990) *Gene* 91:151-158; Ballas, et al., (1989) *Nucleic Acids Res.* 17:7891-7903 and Joshi, et al., (1987) *Nucleic Acid Res.* 15:9627-9639.

Where appropriate, a nucleic acid may be optimized for increased expression in the host organism. Thus, where the host organism is a plant, the synthetic nucleic acids can be synthesized using plant-preferred codons for improved expression. See, for example, Campbell and Gowri, (1990) *Plant Physiol.* 92:1-11 for a discussion of host-preferred codon usage. For example, although nucleic acid sequences of the embodiments may be expressed in both monocotyledonous and dicotyledonous plant species, sequences can be modified to account for the specific codon preferences and GC content preferences of monocotyledons or dicotyledons as these preferences have been shown to differ (Murray et al. (1989) *Nucleic Acids Res.* 17:477-498). Thus, the maize-preferred codon for a particular amino acid may be derived from known gene sequences from maize. Maize codon usage for 28 genes from maize plants is listed in Table 4 of Murray, et al., supra. Methods are available in the art for synthesizing plant-preferred genes. See, for example, U.S. Pat. Nos. 5,380,831, and 5,436,391 and Murray, et al., (1989) *Nucleic Acids Res.* 17:477-498, and Liu H et al. *Mol Bio Rep* 37:677-684, 2010, herein incorporated by reference. A *Zea* maize codon usage table can be also found at kazusa.or.jp/codon/cgi-bin/showcodon.cgi?species=4577, which can be accessed using the www prefix. Table 3 shows a maize optimal codon analysis (adapted from Liu H et al. *Mol Bio Rep* 37:677-684, 2010).

TABLE 3

| Amino Acid | Codon | High Count | RSCU | Low Count | RSCU |
|---|---|---|---|---|---|
| Phe | UUU | 115 | 0.04 | 2,301 | 1.22 |
|  | UUC* | 5,269 | 1.96 | 1,485 | 0.78 |
| Ser | UCU | 176 | 0.13 | 2,498 | 1.48 |
|  | UCC* | 3,489 | 2.48 | 1,074 | 0.63 |
|  | UCA | 104 | 0.07 | 2,610 | 1.54 |
|  | UCG* | 1,975 | 1.4 | 670 | 0.4 |
|  | AGU | 77 | 0.05 | 1,788 | 1.06 |
|  | AGC* | 2,617 | 1.86 | 1,514 | 0.89 |
| Leu | UUA | 10 | 0.01 | 1,326 | 0.79 |
|  | UUG | 174 | 0.09 | 2,306 | 1.37 |
|  | CUU | 223 | 0.11 | 2,396 | 1.43 |
|  | CUC* | 5,979 | 3.08 | 1,109 | 0.66 |
|  | CUA | 106 | 0.05 | 1,280 | 0.76 |
|  | CUG* | 5,161 | 2.66 | 1,646 | 0.98 |
| Pro | CCU | 427 | 0.22 | 1,900 | 1.47 |
|  | CCC* | 3,035 | 1.59 | 601 | 0.47 |
|  | CCA | 311 | 0.16 | 2,140 | 1.66 |
|  | CCG* | 3,846 | 2.02 | 513 | 0.4 |
| Ile | AUU | 138 | 0.09 | 2,388 | 1.3 |
|  | AUC* | 4,380 | 2.85 | 1,353 | 0.74 |
|  | AUA | 88 | 0.06 | 1,756 | 0.96 |
| Thr | ACU | 136 | 0.09 | 1,990 | 1.43 |
|  | ACC* | 3,398 | 2.25 | 991 | 0.71 |
|  | ACA | 133 | 0.09 | 2,075 | 1.5 |
|  | ACG* | 2,378 | 1.57 | 495 | 0.36 |
| Val | GUU | 182 | 0.07 | 2,595 | 1.51 |
|  | GUC* | 4,584 | 1.82 | 1,096 | 0.64 |
|  | GUA | 74 | 0.03 | 1,325 | 0.77 |
|  | GUG* | 5,257 | 2.08 | 1,842 | 1.07 |
| Ala | GCU | 629 | 0.17 | 3,063 | 1.59 |
|  | GCC* | 8,057 | 2.16 | 1,136 | 0.59 |
|  | GCA | 369 | 0.1 | 2,872 | 1.49 |
|  | GCG* | 5,835 | 1.57 | 630 | 0.33 |
| Tyr | UAU | 71 | 0.04 | 1,632 | 1.22 |
|  | UAC* | 3,841 | 1.96 | 1,041 | 0.78 |
| His | CAU | 131 | 0.09 | 1,902 | 1.36 |
|  | CAC* | 2,800 | 1.91 | 897 | 0.64 |
| Cys | UGU | 52 | 0.04 | 1,233 | 1.12 |
|  | UGC* | 2,291 | 1.96 | 963 | 0.88 |
| Gln | CAA | 99 | 0.05 | 2,312 | 1.04 |
|  | CAG* | 3,557 | 1.95 | 2,130 | 0.96 |
| Arg | CGU | 153 | 0.12 | 751 | 0.74 |
|  | CGC* | 4,278 | 3.25 | 466 | 0.46 |
|  | CGA | 92 | 0.07 | 659 | 0.65 |
|  | CGG* | 1,793 | 1.36 | 631 | 0.62 |
|  | AGA | 83 | 0.06 | 1,948 | 1.91 |
|  | AGG* | 1,493 | 1.14 | 1,652 | 1.62 |
| Asn | AAU | 131 | 0.07 | 3,074 | 1.26 |
|  | AAC* | 3,814 | 1.93 | 1,807 | 0.74 |
| Lys | AAA | 130 | 0.05 | 3,215 | 0.98 |
|  | AAG* | 5,047 | 1.95 | 3,340 | 1.02 |
| Asp | GAU | 312 | 0.09 | 4,217 | 1.38 |
|  | GAC* | 6,729 | 1.91 | 1,891 | 0.62 |
| Gly | GGU | 363 | 0.13 | 2,301 | 1.35 |
|  | GGC* | 7,842 | 2.91 | 1,282 | 0.75 |
|  | GGA | 397 | 0.15 | 2,044 | 1.19 |
|  | GGG* | 2,186 | 0.81 | 1,215 | 0.71 |

TABLE 3-continued

| Amino Acid | Codon | High Count | RSCU | Low Count | RSCU |
|---|---|---|---|---|---|
| Glu | GAA | 193 | 0.06 | 4,080 | 1.1 |
| | GAG* | 6,010 | 1.94 | 3,307 | 0.9 |

Codon usage was compared using Chi squared contingency test to identify optimal codons. Codons that occur significantly more often (P\0.01) are indicated with an asterisk.

TABLE 4

| Codon | AA | Freq | Count |
|---|---|---|---|
| TTT | F | 21.2 | (10493) |
| TTC | F | 21.2 | (10487) |
| TTA | L | 9.2 | (4545) |
| TTG | L | 22.9 | (11340) |
| CTT | L | 23.9 | (11829) |
| CTC | L | 17.1 | (8479) |
| CTA | L | 8.5 | (4216) |
| CTG | L | 12.7 | (6304) |
| ATT | I | 25.1 | (12411) |
| ATC | I | 16.3 | (8071) |
| ATA | I | 12.9 | (6386) |
| ATG | M | 22.7 | (11218) |
| GTT | V | 26.1 | (12911) |
| GTC | V | 11.9 | (5894) |
| GTA | V | 7.7 | (3803) |
| GTG | V | 21.4 | (10610) |
| TAT | Y | 15.7 | (7779) |
| TAC | Y | 14.9 | (7367) |
| TAA | * | 0.9 | (463) |
| TAG | * | 0.5 | (263) |
| CAT | H | 14.0 | (6930) |
| CAC | H | 11.6 | (5759) |
| CAA | Q | 20.5 | (10162) |
| CAG | Q | 16.2 | (8038) |
| AAT | N | 22.4 | (11088) |
| AAC | N | 22.8 | (11284) |
| AAA | K | 26.9 | (13334) |
| AAG | K | 35.9 | (17797) |
| GAT | D | 32.4 | (16040) |
| GAC | D | 20.4 | (10097) |
| GAA | E | 33.2 | (16438) |
| GAG | E | 33.2 | (16426) |
| TCT | S | 18.4 | (9107) |
| TCC | S | 12.9 | (6409) |
| TCA | S | 15.6 | (7712) |
| TCG | S | 4.8 | (2397) |
| CCT | P | 18.9 | (9358) |
| CCC | P | 10.1 | (5010) |
| CCA | P | 19.1 | (9461) |
| CCG | P | 4.7 | (2312) |
| ACT | T | 17.1 | (8490) |
| ACC | T | 14.3 | (7100) |
| ACA | T | 14.9 | (7391) |
| ACG | T | 4.3 | (2147) |
| GCT | A | 26.7 | (13201) |
| GCC | A | 16.2 | (8026) |
| GCA | A | 21.4 | (10577) |
| GCG | A | 6.3 | (3123) |
| TGT | C | 8.1 | (3995) |
| TGC | C | 8.0 | (3980) |
| TGA | * | 1.0 | (480) |
| TGG | W | 13.0 | (6412) |
| CGT | R | 6.6 | (3291) |
| CGC | R | 6.2 | (3093) |
| CGA | R | 4.1 | (2018) |
| CGG | R | 3.1 | (1510) |
| AGT | S | 12.6 | (6237) |
| AGC | S | 11.3 | (5594) |
| AGA | R | 14.8 | (7337) |
| AGG | R | 13.3 | (6574) |
| GGT | G | 20.9 | (10353) |
| GGC | G | 13.4 | (6650) |
| GGA | G | 22.3 | (11022) |
| GGG | G | 13.0 | (6431) |

A *Glycine max* codon usage table is shown in Table 4 and can also be found at kazusa.or.jp/codon/cgi-bin/showcodon.cgi?species=3847&aa=1&style=N, which can be accessed using the www prefix.

In some embodiments the recombinant nucleic acid molecule encoding a PtIP-83 polypeptide has maize optimized codons.

Additional sequence modifications are known to enhance gene expression in a cellular host. These include elimination of sequences encoding spurious polyadenylation signals, exon-intron splice site signals, transposon-like repeats, and other well-characterized sequences that may be deleterious to gene expression. The GC content of the sequence may be adjusted to levels average for a given cellular host, as calculated by reference to known genes expressed in the host cell. The term "host cell" as used herein refers to a cell which contains a vector and supports the replication and/or expression of the expression vector is intended. Host cells may be prokaryotic cells such as *E. coli* or eukaryotic cells such as yeast, insect, amphibian or mammalian cells or monocotyledonous or dicotyledonous plant cells. An example of a monocotyledonous host cell is a maize host cell. When possible, the sequence is modified to avoid PtIP-hairpin secondary mRNA structures.

The expression cassettes may additionally contain 5' leader sequences. Such leader sequences can act to enhance translation. Translation leaders are known in the art and include: picornavirus leaders, for example, EMCV leader (Encephalomyocarditis 5' noncoding region) (Elroy-Stein, et al., (1989) *Proc. Natl. Acad. Sci. USA* 86:6126-6130); potyvirus leaders, for example, TEV leader (Tobacco Etch Virus) (Gallie, et al., (1995) *Gene* 165(2):233-238), MDMV leader (Maize Dwarf Mosaic Virus), human immunoglobulin heavy-chain binding protein (BiP) (Macejak, et al., (1991) *Nature* 353:90-94); untranslated leader from the coat protein mRNA of alfalfa mosaic virus (AMV RNA 4) (Jobling, et al., (1987) *Nature* 325:622-625); tobacco mosaic virus leader (TMV) (Gallie, et al., (1989) in *Molecular Biology of RNA*, ed. Cech (Liss, New York), pp. 237-256) and maize chlorotic mottle virus leader (MCMV) (Lommel, et al., (1991) *Virology* 81:382-385). See also, Della-Cioppa, et al., (1987) *Plant Physiol.* 84:965-968. Such constructs may also contain a "signal sequence" or "leader sequence" to facilitate co-translational or post-translational transport of the peptide to certain intracellular structures such as the chloroplast (or other plastid), endoplasmic reticulum or Golgi apparatus.

"Signal sequence" as used herein refers to a sequence that is known or suspected to result in cotranslational or post-translational peptide transport across the cell membrane. In eukaryotes, this typically involves secretion into the Golgi apparatus, with some resulting glycosylation. Insecticidal toxins of bacteria are often synthesized as protoxins, which are protolytically activated in the gut of the target pest (Chang, (1987) *Methods Enzymol.* 153:507-516). In some embodiments, the signal sequence is located in the native sequence or may be derived from a sequence of the embodiments. "Leader sequence" as used herein refers to any sequence that when translated, results in an amino acid sequence sufficient to trigger co-translational transport of the peptide chain to a subcellular organelle. Thus, this includes leader sequences targeting transport and/or glycosylation by passage into the endoplasmic reticulum, passage to vacuoles, plastids including chloroplasts, mitochondria, and the like. Nuclear-encoded proteins targeted to the chloroplast thylakoid lumen compartment have a characteristic bipartite transit peptide, composed of a stromal targeting signal peptide and a lumen targeting signal peptide. The stromal targeting information is in the amino-proximal portion of the transit peptide. The lumen targeting signal peptide is in the carboxyl-proximal portion of the transit peptide, and contains all the information for targeting to the lumen. Recent research in proteomics of the higher plant chloroplast has achieved in the identification of numerous nuclear-encoded lumen proteins (Kieselbach et al. *FEBS LETT* 480:271-276, 2000; Peltier et al. *Plant Cell* 12:319-341, 2000; Bricker et al. *Biochim. Biophys Acta* 1503:350-356, 2001), the lumen targeting signal peptide of which can potentially be used in accordance with the present disclosure. About 80 proteins from *Arabidopsis*, as well as homologous proteins from spinach and garden pea, are reported by Kieselbach et al., *Photosynthesis Research,* 78:249-264, 2003. In particular, Table 2 of this publication, which is incorporated into the description herewith by reference, discloses 85 proteins from the chloroplast lumen, identified by their accession number (see also US Patent Application Publication 2009/09044298). In addition, the recently published draft version of the rice genome (Goff et al, *Science* 296:92-100, 2002) is a suitable source for lumen targeting signal peptide which may be used in accordance with the present disclosure.

Suitable chloroplast transit peptides (CTP) are well known to one skilled in the art also include chimeric CTPs comprising but not limited to, an N-terminal domain, a central domain or a C-terminal domain from a CTP from *Oryza sativa* 1-deoxy-D xyulose-5-Phosphate Synthase *oryza sativa*-Superoxide dismutase *oryza sativa*-soluble starch synthase *oryza sativa*-NADP-dependent Malic acid enzyme *oryza sativa*-Phospho-2-dehydro-3-deoxyheptonate Aldolase 2 *oryza sativa*-L-Ascorbate peroxidase 5 *oryza sativa*-Phosphoglucan water dikinase, *Zea Mays* ssRUBISCO, *Zea Mays*-beta-glucosidase, *Zea Mays*-Malate dehydrogenase, *Zea Mays* Thioredoxin M-type US Patent Application Publication 2012/0304336).

The PtIP-83 polypeptide gene to be targeted to the chloroplast may be optimized for expression in the chloroplast to account for differences in codon usage between the plant nucleus and this organelle. In this manner, the nucleic acids of interest may be synthesized using chloroplast-preferred codons. See, for example, U.S. Pat. No. 5,380,831, herein incorporated by reference.

In preparing the expression cassette, the various DNA fragments may be manipulated so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites or the like. For this purpose, in vitro mutagenesis, primer repair, restriction, annealing, resubstitutions, e.g., transitions and transversions, may be involved.

A number of promoters can be used in the practice of the embodiments. The promoters can be selected based on the desired outcome. The nucleic acids can be combined with constitutive, tissue-preferred, inducible or other promoters for expression in the host organism. Suitable constitutive promoters for use in a plant host cell include, for example, the core promoter of the Rsyn7 promoter and other constitutive promoters disclosed in WO 1999/43838 and U.S. Pat. No. 6,072,050; the core CaMV 35S promoter (Odell, et al., (1985) *Nature* 313:810-812); rice actin (McElroy, et al., (1990) *Plant Cell* 2:163-171); ubiquitin (Christensen, et al., (1989) *Plant Mol. Biol.* 12:619-632 and Christensen, et al., (1992) *Plant Mol. Biol.* 18:675-689); pEMU (Last, et al., (1991) *Theor. Appl. Genet.* 81:581-588); MAS (Velten, et al., (1984) *EMBO J.* 3:2723-2730); ALS promoter (U.S. Pat. No. 5,659,026) and the like. Other constitutive promoters include, for example, those discussed in U.S. Pat. Nos. 5,608,149; 5,608,144; 5,604,121; 5,569,597; 5,466,785; 5,399,680; 5,268,463; 5,608,142 and 6,177,611.

Depending on the desired outcome, it may be beneficial to express the gene from an inducible promoter. Of particular interest for regulating the expression of the nucleotide sequences of the embodiments in plants are wound-inducible promoters. Such wound-inducible promoters, may respond to damage caused by insect feeding, and include potato proteinase inhibitor (pin II) gene (Ryan, (1990) *Ann. Rev. Phytopath.* 28:425-449; Duan, et al., (1996) *Nature Biotechnology* 14:494-498); wun1 and wun2, U.S. Pat. No. 5,428,148; win1 and win2 (Stanford, et al., (1989) *Mol. Gen. Genet.* 215:200-208); systemin (McGurl, et al., (1992) *Science* 225:1570-1573); WIP1 (Rohmeier, et al., (1993) *Plant Mol. Biol.* 22:783-792; Eckelkamp, et al., (1993) *FEBS Letters* 323:73-76); MPI gene (Corderok, et al., (1994) *Plant J.* 6(2):141-150) and the like, herein incorporated by reference.

Additionally, pathogen-inducible promoters may be employed in the methods and nucleotide constructs of the embodiments. Such pathogen-inducible promoters include those from pathogenesis-related proteins (PR proteins), which are induced following infection by a pathogen; e.g., PR proteins, SAR proteins, beta-1,3-glucanase, chitinase, etc. See, for example, Redolfi, et al., (1983) *Neth. J. Plant Pathol.* 89:245-254; Uknes, et al., (1992) *Plant Cell* 4: 645-656 and Van Loon, (1985) *Plant Mol. Virol.* 4:111-116. See also, WO 1999/43819, herein incorporated by reference.

Of interest are promoters that are expressed locally at or near the site of pathogen infection. See, for example, Marineau, et al., (1987) *Plant Mol. Biol.* 9:335-342; Matton, et al., (1989) *Molecular Plant-Microbe Interactions* 2:325-331; Somsisch, et al., (1986) *Proc. Natl. Acad. Sci. USA* 83:2427-2430; Somsisch, et al., (1988) *Mol. Gen. Genet.* 2:93-98 and Yang, (1996) *Proc. Natl. Acad. Sci. USA* 93:14972-14977. See also, Chen, et al., (1996) *Plant J.* 10:955-966; Zhang, et al., (1994) *Proc. Natl. Acad. Sci. USA* 91:2507-2511; Warner, et al., (1993) *Plant J.* 3:191-201; Siebertz, et al., (1989) *Plant Cell* 1:961-968; U.S. Pat. No. 5,750,386 (nematode-inducible) and the references cited therein. Of particular interest is the inducible promoter for the maize PRms gene, whose expression is induced by the pathogen *Fusarium moniliforme* (see, for example, Cordero, et al., (1992) *Physiol. Mol. Plant Path.* 41:189-200).

Chemical-regulated promoters can be used to modulate the expression of a gene in a plant through the application of an exogenous chemical regulator. Depending upon the objective, the promoter may be a chemical-inducible promoter, where application of the chemical induces gene expression or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena, et al., (1991) *Proc. Natl. Acad. Sci. USA* 88:10421-10425 and McNellis, et al., (1998) *Plant J.* 14(2):247-257) and tetracycline-inducible and tetracycline-repressible promoters (see, for example, Gatz, et al., (1991) *Mol. Gen. Genet.* 227:229-237 and U.S. Pat. Nos. 5,814,618 and 5,789,156), herein incorporated by reference.

Tissue-preferred promoters can be utilized to target enhanced PtIP-83 polypeptide expression within a particular plant tissue. Tissue-preferred promoters include those discussed in Yamamoto, et al., (1997) *Plant J.* 12(2)255-265; Kawamata, et al., (1997) *Plant Cell Physiol.* 38(7):792-803; Hansen, et al., (1997) *Mol. Gen Genet.* 254(3):337-343; Russell, et al., (1997) *Transgenic Res.* 6(2):157-168; Rinehart, et al., (1996) *Plant Physiol.* 112(3):1331-1341; Van Camp, et al., (1996) *Plant Physiol.* 112(2):525-535; Canevascini, et al., (1996) *Plant Physiol.* 112(2):513-524; Yamamoto, et al., (1994) *Plant Cell Physiol.* 35(5):773-778; Lam, (1994) *Results Probl. Cell Differ.* 20:181-196; Orozco, et al., (1993) *Plant Mol Biol.* 23(6):1129-1138; Matsuoka, et al., (1993) *Proc Natl. Acad. Sci. USA* 90(20):9586-9590 and Guevara-Garcia, et al., (1993) *Plant J.* 4(3):495-505. Such promoters can be modified, if necessary, for weak expression.

Leaf-preferred promoters are known in the art. See, for example, Yamamoto, et al., (1997) *Plant J.* 12(2):255-265; Kwon, et al., (1994) *Plant Physiol.* 105:357-67; Yamamoto, et al., (1994) *Plant Cell Physiol.* 35(5):773-778; Gotor, et al., (1993) *Plant J.* 3:509-18; Orozco, et al., (1993) *Plant Mol. Biol.* 23(6):1129-1138 and Matsuoka, et al., (1993) *Proc. Natl. Acad. Sci. USA* 90(20):9586-9590.

Root-preferred or root-specific promoters are known and can be selected from the many available from the literature or isolated de novo from various compatible species. See, for example, Hire, et al., (1992) *Plant Mol. Biol.* 20(2):207-218 (soybean root-specific glutamine synthetase gene); Keller and Baumgartner, (1991) *Plant Cell* 3(10):1051-1061 (root-specific control element in the GRP 1.8 gene of French bean); Sanger, et al., (1990) *Plant Mol. Biol.* 14(3):433-443 (root-specific promoter of the mannopine synthase (MAS) gene of *Agrobacterium tumefaciens*) and Miao, et al., (1991) *Plant Cell* 3(1):11-22 (full-length cDNA clone encoding cytosolic glutamine synthetase (GS), which is expressed in roots and root nodules of soybean). See also, Bogusz, et al., (1990) *Plant Cell* 2(7):633-641, where two root-specific promoters isolated from hemoglobin genes from the nitrogen-fixing nonlegume *Parasponia andersonii* and the related non-nitrogen-fixing nonlegume *Trema tomentosa* are described. The promoters of these genes were linked to a β-glucuronidase reporter gene and introduced into both the nonlegume *Nicotiana tabacum* and the legume *Lotus corniculatus*, and in both instances root-specific promoter activity was preserved. Leach and Aoyagi, (1991) describe their analysis of the promoters of the highly expressed rolC and rolD root-inducing genes of *Agrobacterium rhizogenes* (see, *Plant Science* (Limerick) 79(1):69-76). They concluded that enhancer and tissue-preferred DNA determinants are dissociated in those promoters. Teeri, et al., (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see, *EMBO J.* 8(2): 343-350). The TR1' gene fused to nptII (neomycin phosphotransferase II) showed similar characteristics. Additional root-preferred promoters include the VfENOD-GRP3 gene promoter (Kuster, et al., (1995) *Plant Mol. Biol.* 29(4):759-772) and rolB promoter (Capana, et al., (1994) *Plant Mol. Biol.* 25(4):681-691. See also, U.S. Pat. Nos. 5,837,876; 5,750,386; 5,633,363; 5,459,252; 5,401,836; 5,110,732 and 5,023,179. *Arabidopsis thaliana* root-preferred regulatory sequences are disclosed in US20130117883.

"Seed-preferred" promoters include both "seed-specific" promoters (those promoters active during seed development such as promoters of seed storage proteins) as well as "seed-germinating" promoters (those promoters active during seed germination). See, Thompson, et al., (1989) *BioEssays* 10:108, herein incorporated by reference. Such seed-preferred promoters include, but are not limited to, Cim1 (cytokinin-induced message); cZ19B1 (maize 19 kDa zein); and milps (myo-inositol-1-phosphate synthase) (see, U.S. Pat. No. 6,225,529, herein incorporated by reference). Gamma-zein and Glb-1 are endosperm-specific promoters. For dicots, seed-specific promoters include, but are not limited to, Kunitz trypsin inhibitor 3 (KTi3) (Jofuku and Goldberg, (1989) *Plant Cell* 1:1079-1093), bean β-phaseolin, napin, β-conglycinin, glycinin 1, soybean lectin, cruciferin, and the like. For monocots, seed-specific promoters include, but are not limited to, maize 15 kDa zein, 22 kDa zein, 27 kDa zein, g-zein, waxy, shrunken 1, shrunken 2, globulin 1, etc. See also, WO 2000/12733, where seed-preferred promoters from end1 and end2 genes are disclosed; herein incorporated by reference. In dicots, seed specific promoters include but are not limited to seed coat promoter from *Arabidopsis*, pBAN; and the early seed promoters from *Arabidopsis*, p26, p63, and p63tr (U.S. Pat. Nos. 7,294,760 and 7,847,153). A promoter that has "preferred" expression in a particular tissue is expressed in that tissue to a greater degree than in at least one other plant tissue. Some tissue-preferred promoters show expression almost exclusively in the particular tissue.

Where low level expression is desired, weak promoters will be used. Generally, the term "weak promoter" as used herein refers to a promoter that drives expression of a coding sequence at a low level. By low level expression at levels of between about $1/1000$ transcripts to about $1/100,000$ transcripts to about $1/500,000$ transcripts is intended. Alternatively, it is recognized that the term "weak promoters" also encompasses promoters that drive expression in only a few cells and not in others to give a total low level of expression. Where a promoter drives expression at unacceptably high levels, portions of the promoter sequence can be deleted or modified to decrease expression levels.

Such weak constitutive promoters include, for example the core promoter of the Rsyn7 promoter (WO 1999/43838 and U.S. Pat. No. 6,072,050), the core 35S CaMV promoter, and the like. Other constitutive promoters include, for example, those disclosed in U.S. Pat. Nos. 5,608,149; 5,608, 144; 5,604,121; 5,569,597; 5,466,785; 5,399,680; 5,268, 463; 5,608,142 and 6,177,611, herein incorporated by reference.

The above list of promoters is not meant to be limiting. Any appropriate promoter can be used in the embodiments.

Generally, the expression cassette will comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones and 2,4-dichlorophenoxyacetate (2,4-D). Additional examples of suitable selectable marker genes include, but are not limited to, genes encoding resistance to chloramphenicol (Herrera Estrella, et al., (1983) *EMBO J.* 2:987-992); methotrexate (Herrera Estrella, et al., (1983) *Nature* 303:209-213 and Meijer, et al., (1991) *Plant Mol. Biol.* 16:807-820); streptomycin (Jones, et al., (1987) *Mol. Gen. Genet.* 210:86-91); spectinomycin (Bretagne-Sagnard, et al., (1996) *Transgenic Res.* 5:131-137); bleomycin (Hille, et al., (1990) *Plant Mol. Biol.* 7:171-176); sulfonamide (Guerineau, et al., (1990) *Plant Mol. Biol.* 15:127-136); bromoxynil (Stalker, et al., (1988) *Science* 242:419-423); glyphosate (Shaw, et al., (1986) *Science* 233:478-481 and U.S. patent application Ser. Nos. 10/004,357 and 10/427,692); phosphinothricin (DeBlock, et al., (1987) *EMBO J.* 6:2513-2518). See generally, Yarranton, (1992) *Curr. Opin. Biotech.* 3:506-511; Christopherson, et al., (1992) *Proc. Natl. Acad. Sci. USA* 89:6314-6318; Yao, et al., (1992) *Cell* 71:63-72; Reznikoff, (1992) *Mol. Microbiol.* 6:2419-2422; Barkley, et al., (1980) in *The Operon*, pp. 177-220; Hu, et al., (1987) *Cell* 48:555-566; Brown, et al., (1987) *Cell* 49:603-612; Figge, et al., (1988) *Cell* 52:713-722; Deuschle, et al., (1989) *Proc. Natl. Acad. Sci. USA* 86:5400-5404; Fuerst, et al., (1989) *Proc. Natl. Acad. Sci. USA* 86:2549-2553; Deuschle, et al., (1990) *Science* 248:480-483; Gossen, (1993) Ph.D. Thesis, University of Heidelberg; Reines, et al., (1993) *Proc. Natl. Acad. Sci. USA* 90:1917-1921; Labow, et al., (1990) *Mol. Cell. Biol.* 10:3343-3356; Zambretti, et al., (1992) *Proc. Natl. Acad. Sci. USA* 89:3952-3956; Baim, et al., (1991) *Proc. Natl. Acad. Sci. USA* 88:5072-5076; Wyborski, et al., (1991) *Nucleic Acids Res.* 19:4647-4653; Hillenand-Wissman, (1989) *Topics Mol. Struc. Biol.* 10:143-162; Degenkolb, et al., (1991) *Antimicrob. Agents Chemother.* 35:1591-1595; Kleinschnidt, et al., (1988) *Biochemistry* 27:1094-1104; Bonin, (1993) Ph.D. Thesis, University of Heidelberg; Gossen, et al., (1992) *Proc. Natl. Acad. Sci. USA* 89:5547-5551; Oliva, et al., (1992) *Antimicrob. Agents Chemother.* 36:913-919; Hlavka, et al., (1985) *Handbook of Experimental Pharmacology*, Vol. 78 (Springer-Verlag, Berlin) and Gill, et al., (1988) *Nature* 334:721-724. Such disclosures are herein incorporated by reference.

The above list of selectable marker genes is not meant to be limiting. Any selectable marker gene can be used in the embodiments.

Plant Transformation

The methods of the embodiments involve introducing a polypeptide or polynucleotide into a plant. "Introducing" is as used herein means presenting to the plant the polynucleotide or polypeptide in such a manner that the sequence gains access to the interior of a cell of the plant. The methods of the embodiments do not depend on a particular method for introducing a polynucleotide or polypeptide into a plant, only that the polynucleotide or polypeptides gains access to the interior of at least one cell of the plant. Methods for introducing polynucleotide or polypeptides into plants are known in the art including, but not limited to, stable transformation methods, transient transformation methods, and virus-mediated methods.

"Stable transformation" is as used herein means that the nucleotide construct introduced into a plant integrates into the genome of the plant and is capable of being inherited by the progeny thereof. "Transient transformation" as used herein means that a polynucleotide is introduced into the plant and does not integrate into the genome of the plant or a polypeptide is introduced into a plant. "Plant" as used herein refers to whole plants, plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells and pollen).

Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway, et al., (1986) *Biotechniques* 4:320-334), electroporation (Riggs, et al., (1986) *Proc. Natl. Acad. Sci. USA* 83:5602-5606), *Agrobacterium*-mediated transformation (U.S. Pat. Nos. 5,563,055 and 5,981,840), direct gene transfer (Paszkowski, et al., (1984) *EMBO J.* 3:2717-2722) and ballistic particle acceleration (see, for example, U.S. Pat. Nos. 4,945,050; 5,879,918; 5,886,244 and 5,932,782; Tomes, et al., (1995) in *Plant Cell, Tissue, and Organ Culture: Fundamental Methods*, ed. Gamborg and Phillips, (Springer-Verlag, Berlin) and McCabe, et al., (1988) *Biotechnology* 6:923-926) and Led transformation (WO 00/28058). For potato transformation see, Tu, et al., (1998) *Plant Molecular Biology* 37:829-838 and Chong, et al., (2000) *Transgenic Research* 9:71-78. Additional transformation procedures can be found in Weissinger, et al., (1988) *Ann. Rev. Genet.* 22:421-477; Sanford, et al., (1987) *Particulate Science and Technology* 5:27-37 (onion); Christou, et al., (1988) *Plant Physiol.* 87:671-674 (soybean); McCabe, et al., (1988) *Bio/Technology* 6:923-926 (soybean); Finer and McMullen, (1991) *In Vitro Cell Dev. Biol.* 27P:175-182 (soybean); Singh, et al., (1998) *Theor. Appl. Genet.* 96:319-324 (soybean); Datta, et al., (1990) *Biotechnology* 8:736-740 (rice); Klein, et al., (1988) *Proc. Natl. Acad. Sci. USA* 85:4305-4309 (maize); Klein, et al., (1988) *Biotechnology* 6:559-563 (maize); U.S. Pat. Nos. 5,240,855; 5,322,783 and 5,324,646; Klein, et al., (1988) *Plant Physiol.* 91:440-444 (maize); Fromm, et al., (1990) *Biotechnology* 8:833-839 (maize); Hooykaas-Van Slogteren, et al., (1984) *Nature (London)* 311:763-764; U.S. Pat. No. 5,736,369 (cereals); Bytebier, et al., (1987) *Proc. Natl. Acad. Sci. USA* 84:5345-5349 (Liliaceae); De Wet, et al., (1985) in *The Experimental Manipulation of Ovule Tissues*, ed. Chapman, et al., (Longman, New York), pp. 197-209 (pollen); Kaeppler, et al., (1990) *Plant Cell Reports* 9:415-418 and Kaeppler, et al., (1992) *Theor. Appl. Genet.* 84:560-566 (whisker-mediated transformation); D'Halluin, et al., (1992) *Plant Cell* 4:1495-1505 (electroporation); Li, et al., (1993) *Plant Cell Reports* 12:250-255 and Christou and Ford, (1995) *Annals of Botany* 75:407-413 (rice); Osjoda, et al., (1996) *Nature Biotechnology* 14:745-750 (maize via *Agrobacterium tumefaciens*); all of which are herein incorporated by reference.

In specific embodiments, the sequences of the embodiments can be provided to a plant using a variety of transient transformation methods. Such transient transformation methods include, but are not limited to, the introduction of the PtIP-83 polynucleotide or variants and fragments thereof directly into the plant or the introduction of the PtIP-83 polypeptide transcript into the plant. Such methods include, for example, microinjection or particle bombardment. See, for example, Crossway, et al., (1986) *Mol Gen. Genet.* 202:179-185; Nomura, et al., (1986) *Plant Sci.* 44:53-58; Hepler, et al., (1994) *Proc. Natl. Acad. Sci.* 91:2176-2180 and Hush, et al., (1994) *The Journal of Cell Science* 107:775-784, all of which are herein incorporated by reference. Alternatively, the PtIP-83 polypeptide polynucleotide can be transiently transformed into the plant using techniques known in the art. Such techniques include viral vector system and the precipitation of the polynucleotide in a manner that precludes subsequent release of the DNA. Thus, transcription from the particle-bound DNA can occur, but the frequency with which it is released to become integrated into the genome is greatly reduced. Such methods include the use of particles coated with polyethylimine (PEI; Sigma #P3143).

Methods are known in the art for the targeted insertion of a polynucleotide at a specific location in the plant genome. In one embodiment, the insertion of the polynucleotide at a desired genomic location is achieved using a site-specific recombination system. See, for example, WO 1999/25821, WO 1999/25854, WO 1999/25840, WO 1999/25855 and WO 1999/25853, all of which are herein incorporated by reference. Briefly, the polynucleotide of the embodiments can be contained in transfer cassette flanked by two non-identical recombination sites. The transfer cassette is introduced into a plant have stably incorporated into its genome a target site which is flanked by two non-identical recombination sites that correspond to the sites of the transfer cassette. An appropriate recombinase is provided and the transfer cassette is integrated at the target site. The polynucleotide of interest is thereby integrated at a specific chromosomal position in the plant genome.

Plant transformation vectors may be comprised of one or more DNA vectors needed for achieving plant transformation. For example, it is a common practice in the art to utilize plant transformation vectors that are comprised of more than one contiguous DNA segment. These vectors are often referred to in the art as "binary vectors". Binary vectors as well as vectors with helper plasmids are most often used for *Agrobacterium*-mediated transformation, where the size and complexity of DNA segments needed to achieve efficient transformation is quite large, and it is advantageous to separate functions onto separate DNA molecules. Binary vectors typically contain a plasmid vector that contains the cis-acting sequences required for T-DNA transfer (such as left border and right border), a selectable marker that is engineered to be capable of expression in a plant cell, and a "gene of interest" (a gene engineered to be capable of expression in a plant cell for which generation of transgenic plants is desired). Also present on this plasmid vector are sequences required for bacterial replication. The cis-acting sequences are arranged in a fashion to allow efficient transfer into plant cells and expression therein. For example, the selectable marker gene and the pesticidal gene are located between the left and right borders. Often a second plasmid vector contains the trans-acting factors that mediate T-DNA transfer from *Agrobacterium* to plant cells. This plasmid often contains the virulence functions (Vir genes) that allow infection of plant cells by *Agrobacterium*, and transfer of DNA by cleavage at border sequences and vir-mediated DNA transfer, as is understood in the art (Hellens and Mullineaux, (2000) *Trends in Plant Science* 5:446-451). Several types of *Agrobacterium* strains (e.g. LBA4404, GV3101, EHA101, EHA105, etc.) can be used for plant transformation. The second plasmid vector is not necessary for transforming the plants by other methods such as microprojection, microinjection, electroporation, polyethylene glycol, etc.

In general, plant transformation methods involve transferring heterologous DNA into target plant cells (e.g., immature or mature embryos, suspension cultures, undifferentiated callus, protoplasts, etc.), followed by applying a maximum threshold level of appropriate selection (depending on the selectable marker gene) to recover the transformed plant cells from a group of untransformed cell mass. Following integration of heterologous foreign DNA into plant cells, one then applies a maximum threshold level of appropriate selection in the medium to kill the untransformed cells and separate and proliferate the putatively transformed cells that survive from this selection treatment by transferring regularly to a fresh medium. By continuous passage and challenge with appropriate selection, one identifies and proliferates the cells that are transformed with the plasmid vector. Molecular and biochemical methods can then be used to confirm the presence of the integrated heterologous gene of interest into the genome of the transgenic plant.

Explants are typically transferred to a fresh supply of the same medium and cultured routinely. Subsequently, the transformed cells are differentiated into shoots after placing on regeneration medium supplemented with a maximum threshold level of selecting agent. The shoots are then transferred to a selective rooting medium for recovering rooted shoot or plantlet. The transgenic plantlet then grows into a mature plant and produces fertile seeds (e.g., Hiei, et al., (1994) *The Plant Journal* 6:271-282; Ishida, et al., (1996) *Nature Biotechnology* 14:745-750). Explants are typically transferred to a fresh supply of the same medium and cultured routinely. A general description of the techniques and methods for generating transgenic plants are found in Ayres and Park, (1994) *Critical Reviews in Plant Science* 13:219-239 and Bommineni and Jauhar, (1997) *Maydica* 42:107-120. Since the transformed material contains many cells; both transformed and non-transformed cells are present in any piece of subjected target callus or tissue or group of cells. The ability to kill non-transformed cells and allow transformed cells to proliferate results in transformed plant cultures. Often, the ability to remove non-transformed cells is a limitation to rapid recovery of transformed plant cells and successful generation of transgenic plants.

The cells that have been transformed may be grown into plants in accordance with conventional ways. See, for example, McCormick, et al., (1986) *Plant Cell Reports* 5:81-84. These plants may then be grown, and either pollinated with the same transformed strain or different strains, and the resulting hybrid having constitutive or inducible expression of the desired phenotypic characteristic identified. Two or more generations may be grown to ensure that expression of the desired phenotypic characteristic is stably maintained and inherited and then seeds harvested to ensure that expression of the desired phenotypic characteristic has been achieved.

The nucleotide sequences of the embodiments may be provided to the plant by contacting the plant with a virus or viral nucleic acids. Generally, such methods involve incorporating the nucleotide construct of interest within a viral DNA or RNA molecule. It is recognized that the recombinant proteins of the embodiments may be initially synthesized as part of a viral polyprotein, which later may be processed by proteolysis in vivo or in vitro to produce the desired PtIP-83 polypeptide. It is also recognized that such a viral polyprotein, comprising at least a portion of the amino acid sequence of a PtIP-83 of the embodiments, may have the desired pesticidal activity. Such viral polyproteins and the nucleotide sequences that encode for them are encompassed by the embodiments. Methods for providing plants with nucleotide constructs and producing the encoded proteins in the plants, which involve viral DNA or RNA molecules are known in the art. See, for example, U.S. Pat. Nos. 5,889,191; 5,889,190; 5,866,785; 5,589,367 and 5,316,931; herein incorporated by reference.

Methods for transformation of chloroplasts are known in the art. See, for example, Svab, et al., (1990) *Proc. Natl. Acad. Sci. USA* 87:8526-8530; Svab and Maliga, (1993) *Proc. Natl. Acad. Sci. USA* 90:913-917; Svab and Maliga, (1993) *EMBO J.* 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride, et al., (1994) *Proc. Natl. Acad. Sci. USA* 91:7301-7305.

The embodiments further relate to plant-propagating material of a transformed plant of the embodiments including, but not limited to, seeds, tubers, corms, bulbs, leaves and cuttings of roots and shoots.

The embodiments may be used for transformation of any plant species, including, but not limited to, monocots and dicots. Examples of plants of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria itaica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus* casica), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum. Conifers that may be employed in practicing the embodiments include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). Plants of the embodiments include crop plants (for example, corn, alfalfa, sunflower, *Brassica*, soybean, cotton, safflower, peanut, *sorghum*, wheat, millet, tobacco, etc.), such as corn and soybean plants.

Turf grasses include, but are not limited to: annual bluegrass (*Poa annua*); annual ryegrass (*Lolium multiflorum*); Canada bluegrass (*Poa compressa*); Chewing's fescue (*Festuca rubra*); colonial bentgrass (*Agrostis tenuis*); creeping bentgrass (*Agrostis palustris*); crested wheatgrass (*Agropyron desertorum*); fairway wheatgrass (*Agropyron cristatum*); hard fescue (*Festuca longifolia*); Kentucky bluegrass (*Poa pratensis*); orchardgrass (*Dactylis glomerata*); perennial ryegrass (*Lolium perenne*); red fescue (*Festuca rubra*); redtop (*Agrostis alba*); rough bluegrass (*Poa trivialis*); sheep fescue (*Festuca ovina*); smooth bromegrass (*Bromus inermis*); tall fescue (*Festuca arundinacea*); timothy (*Phleum pratense*); velvet bentgrass (*Agrostis canina*); weeping alkaligrass (*Puccinellia distans*); western wheatgrass (*Agropyron smithii*); Bermuda grass (*Cynodon* spp.); St. Augustine grass (*Stenotaphrum secundatum*); zoysia grass (*Zoysia* spp.); Bahia grass (*Paspalum notatum*); carpet grass (*Axonopus affinis*); centipede grass (*Eremochloa ophiuroides*); kikuyu grass (*Pennisetum clandesinum*); seashore paspalum (*Paspalum vaginatum*); blue gramma (*Bouteloua gracilis*); buffalo grass (*Buchloe dactyloids*); sideoats gramma (*Bouteloua curtipendula*).

Plants of interest include grain plants that provide seeds of interest, oil-seed plants, and leguminous plants. Seeds of interest include grain seeds, such as corn, wheat, barley, rice, *sorghum*, rye, millet, etc. Oil-seed plants include cotton, soybean, safflower, sunflower, *Brassica*, maize, alfalfa, palm, coconut, flax, castor, olive, etc. Leguminous plants include beans and peas. Beans include guar, locust bean, fenugreek, soybean, garden beans, cowpea, mungbean, lima bean, fava bean, lentils, chickpea, etc.

Evaluation of Plant Transformation

Following introduction of heterologous foreign DNA into plant cells, the transformation or integration of heterologous gene in the plant genome is confirmed by various methods such as analysis of nucleic acids, proteins and metabolites associated with the integrated gene.

PCR analysis is a rapid method to screen transformed cells, tissue or shoots for the presence of incorporated gene at the earlier stage before transplanting into the soil (Sambrook and Russell, (2001) Molecular Cloning: A Laboratory Manual. Cold Spring Harbor Laboratory Press, Cold Spring Harbor, N.Y.). PCR is carried out using oligonucleotide primers specific to the gene of interest or *Agrobacterium* vector background, etc.

Plant transformation may be confirmed by Southern blot analysis of genomic DNA (Sambrook and Russell, (2001) supra). In general, total DNA is extracted from the transformant, digested with appropriate restriction enzymes, fractionated in an agarose gel and transferred to a nitrocellulose or nylon membrane. The membrane or "blot" is then probed with, for example, radiolabeled 32P target DNA fragment to confirm the integration of introduced gene into the plant genome according to standard techniques (Sambrook and Russell, (2001) supra).

In Northern blot analysis, RNA is isolated from specific tissues of transformant, fractionated in a formaldehyde agarose gel, and blotted onto a nylon filter according to standard procedures that are routinely used in the art (Sambrook and Russell, (2001) supra). Expression of RNA encoded by the pesticidal gene is then tested by hybridizing the filter to a radioactive probe derived from a pesticidal gene, by methods known in the art (Sambrook and Russell, (2001) supra).

Western blot, biochemical assays and the like may be carried out on the transgenic plants to confirm the presence of protein encoded by the pesticidal gene by standard procedures (Sambrook and Russell, 2001, supra) using antibodies that bind to one or more epitopes present on the PtIP-83 polypeptide.

Stacking of Traits in Transgenic Plant

Transgenic plants may comprise a stack of one or more insecticidal polynucleotides disclosed herein with one or more additional polynucleotides resulting in the production or suppression of multiple polypeptide sequences. Transgenic plants comprising stacks of polynucleotide sequences can be obtained by either or both of traditional breeding methods or through genetic engineering methods. These methods include, but are not limited to, breeding individual lines each comprising a polynucleotide of interest, transforming a transgenic plant comprising a gene disclosed herein with a subsequent gene and co-transformation of genes into a single plant cell. As used herein, the term "stacked" includes having the multiple traits present in the same plant (i.e., both traits are incorporated into the nuclear genome, one trait is incorporated into the nuclear genome and one trait is incorporated into the genome of a plastid or both traits are incorporated into the genome of a plastid). In one non-limiting example, "stacked traits" comprise a molecular stack where the sequences are physically adjacent to each other. A trait, as used herein, refers to the phenotype derived from a particular sequence or groups of sequences. Co-transformation of genes can be carried out using single transformation vectors comprising multiple genes or genes carried separately on multiple vectors. If the sequences are stacked by genetically transforming the plants, the polynucleotide sequences of interest can be combined at any time and in any order. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of the polynucleotide of interest. This may be combined with any combination of other suppression cassettes or overexpression cassettes to generate the desired combination of traits in the plant. It is further recognized that polynucleotide sequences can be stacked at a desired genomic location using a site-specific recombination system. See, for example, WO 1999/25821, WO 1999/25854, WO 1999/25840, WO 1999/25855 and WO 1999/25853, all of which are herein incorporated by reference.

In some embodiments the polynucleotides encoding the PtIP-83 polypeptide disclosed herein, alone or stacked with one or more additional insect resistance traits can be stacked with one or more additional input traits (e.g., herbicide resistance, fungal resistance, virus resistance, stress tolerance, disease resistance, male sterility, stalk strength, and the like) or output traits (e.g., increased yield, modified starches, improved oil profile, balanced amino acids, high lysine or methionine, increased digestibility, improved fiber quality, drought resistance, and the like). Thus, the polynucleotide embodiments can be used to provide a complete agronomic package of improved crop quality with the ability to flexibly and cost effectively control any number of agronomic pests. Transgenes useful for stacking include but are not limited to:
1. Transgenes that Confer Resistance to Insects or Disease and that Encode:
(A) Plant disease resistance genes. Plant defenses are often activated by specific interaction between the product of a disease resistance gene (R) in the plant and the product of a corresponding avirulence (Avr) gene in the pathogen. A plant variety can be transformed with cloned resistance gene to engineer plants that are resistant to specific pathogen strains. See, for example, Jones, et al., (1994) *Science* 266:789 (cloning of the tomato Cf-9 gene for resistance to *Cladosporium fulvum*); Martin, et al., (1993) *Science* 262:1432 (tomato Pto gene for resistance to *Pseudomonas syringae* pv. tomato encodes a protein kinase); Mindrinos, et al., (1994) *Cell* 78:1089 (*Arabidopsis* RSP2 gene for resistance to *Pseudomonas syringae*), McDowell and Woffenden, (2003) *Trends Biotechnol.* 21(4):178-83 and Toyoda, et al., (2002) *Transgenic Res.* 11(6):567-82. A plant resistant to a disease is one that is more resistant to a pathogen as compared to the wild type plant.

(B) Genes encoding a *Bacillus thuringiensis* protein, a derivative thereof or a synthetic polypeptide modeled thereon. See, for example, Geiser, et al., (1986) *Gene* 48:109, who disclose the cloning and nucleotide sequence of a Bt delta-endotoxin gene. Moreover, DNA molecules encoding delta-endotoxin genes can be purchased from American Type Culture Collection (Rockville, Md.), for example, under ATCC® Accession Numbers 40098, 67136, 31995 and 31998. Other non-limiting examples of *Bacillus thuringiensis* transgenes being genetically engineered are given in the following patents and patent applications and hereby are incorporated by reference for this purpose: U.S. Pat. Nos. 5,188,960; 5,689,052; 5,880,275; 5,986,177; 6,023,013, 6,060,594, 6,063,597, 6,077,824, 6,620,988, 6,642,030, 6,713,259, 6,893,826, 7,105,332; 7,179,965, 7,208,474; 7,227,056, 7,288,643, 7,323,556, 7,329,736, 7,449,552, 7,468,278, 7,510,878, 7,521,235, 7,544,862, 7,605,304, 7,696,412, 7,629,504, 7,705,216, 7,772,465, 7,790,846, 7,858,849 and WO 1991/14778; WO 1999/31248; WO 2001/12731; WO 1999/24581 and WO 1997/40162.

Genes encoding pesticidal proteins may also be stacked including but are not limited to: insecticidal proteins from *Pseudomonas* sp. such as PSEEN3174 (Monalysin, (2011) *PLoS Pathogens,* 7:1-13), from *Pseudomonas protegens* strain CHA0 and Pf-5 (previously *fluorescens*) (Pechy-Tarr, (2008) *Environmental Microbiology* 10:2368-2386: GenBank Accession No. EU400157); from *Pseudomonas Taiwanensis* (Liu, et al., (2010) *J. Agric. Food Chem.* 58:12343-12349) and from *Pseudomonas pseudoalcligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxinology Journal* 3:101-118 and Morgan, et al., (2001) *Applied and Envir. Micro.* 67:2062-2069), U.S. Pat. No. 6,048,838, and U.S. Pat. No. 6,379,946; a PIP-1 polypeptide of US Patent Publication US20140007292; an AfIP-1A and/or AfIP-1B polypeptide of US Patent Publication US20140033361; a PHI-4 polypeptide of US patent Publication US20140274885 or PCT Patent Publication WO2014/150914; a PIP-47 polypeptide of PCT Serial Number PCT/US14/51063, a PIP-72 polypeptide of PCT Serial Number PCT/US14/55128, and δ-endotoxins including, but not limited to, the Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry 28, Cry 29, Cry 30, Cry31, Cry32, Cry33, Cry34, Cry35, Cry36, Cry37, Cry38, Cry39, Cry40, Cry41, Cry42, Cry43, Cry44, Cry45, Cry 46, Cry47, Cry49, Cry50, Cry51, Cry52, Cry53, Cry 54, Cry55, Cry56, Cry57, Cry58, Cry59, Cry60, Cry61, Cry62, Cry63, Cry64, Cry65, Cry66, Cry67, Cry68, Cry69, Cry70, Cry71, and Cry 72 classes of δ-endotoxin genes and the *B. thuringiensis* cytolytic Cyt1 and Cyt2 genes. Members of these classes of *B. thuringiensis insecticidal proteins include, but are not limited to Cry*1Aa1 (Accession # AAA22353); Cry1Aa2 (Accession # Accession # AAA22552); Cry1Aa3 (Accession # BAA00257); Cry1Aa4 (Accession # CAA31886); Cry1Aa5 (Accession # BAA04468); Cry1Aa6 (Accession #

AAA86265); Cry1Aa7 (Accession # AAD46139); Cry1Aa8 (Accession # I26149); Cry1Aa9 (Accession # BAA77213); Cry1Aa10 (Accession # AAD55382); Cry1Aa11 (Accession #CAA70856); Cry1Aa12 (Accession # AAP80146); Cry1Aa13 (Accession # AAM44305); Cry1Aa14 (Accession # AAP40639); Cry1Aa15 (Accession # AAY66993); Cry1Aa16 (Accession # HQ439776); Cry1Aa17 (Accession # HQ439788); Cry1Aa18 (Accession # HQ439790); Cry1Aa19 (Accession # HQ685121); Cry1Aa20 (Accession # JF340156); Cry1Aa21 (Accession # JN651496); Cry1Aa22 (Accession # KC158223); Cry1Ab1 (Accession # AAA22330); Cry1Ab2 (Accession # AAA22613); Cry1Ab3 (Accession # AAA22561); Cry1Ab4 (Accession # BAA00071); Cry1Ab5 (Accession # CAA28405); Cry1Ab6 (Accession # AAA22420); Cry1Ab7 (Accession # CAA31620); Cry1Ab8 (Accession # AAA22551); Cry1Ab9 (Accession # CAA38701); Cry1Ab10 (Accession # A29125); Cry1Ab11 (Accession # I12419); Cry1Ab12 (Accession # AAC64003); Cry1Ab13 (Accession # AAN76494); Cry1Ab14 (Accession # AAG16877); Cry1Ab15 (Accession # AAO13302); Cry1Ab16 (Accession # AAK55546); Cry1Ab17 (Accession # AAT46415); Cry1Ab18 (Accession # AAQ88259); Cry1Ab19 (Accession # AAW31761); Cry1Ab20 (Accession # ABB72460); Cry1Ab21 (Accession # ABS18384); Cry1Ab22 (Accession # ABW87320); Cry1Ab23 (Accession # HQ439777); Cry1Ab24 (Accession # HQ439778); Cry1Ab25 (Accession # HQ685122); Cry1Ab26 (Accession # HQ847729); Cry1Ab27 (Accession # JN135249); Cry1Ab28 (Accession # JN135250); Cry1Ab29 (Accession # JN135251); Cry1Ab30 (Accession # JN135252); Cry1Ab31 (Accession # JN135253); Cry1Ab32 (Accession # JN135254); Cry1Ab33 (Accession # AAS93798); Cry1Ab34 (Accession # KC156668); Cry1Ab-like (Accession # AAK14336); Cry1Ab-like (Accession # AAK14337); Cry1Ab-like (Accession # AAK14338); Cry1Ab-like (Accession # ABG88858); Cry1Ac1 (Accession # AAA22331); Cry1Ac2 (Accession # AAA22338); Cry1Ac3 (Accession # CAA38098); Cry1Ac4 (Accession # AAA73077); Cry1Ac5 (Accession # AAA22339); Cry1Ac6 (Accession # AAA86266); Cry1Ac7 (Accession # AAB46989); Cry1Ac8 (Accession # AAC44841); Cry1Ac9 (Accession # AAB49768); Cry1Ac10 (Accession # CAA05505); Cry1Ac11 (Accession # CAA10270); Cry1Ac12 (Accession # I12418); Cry1Ac13 (Accession # AAD38701); Cry1Ac14 (Accession # AAQ06607); Cry1Ac15 (Accession # AAN07788); Cry1Ac16 (Accession # AAU87037); Cry1Ac17 (Accession # AAX18704); Cry1Ac18 (Accession # AAY88347); Cry1Ac19 (Accession # ABD37053); Cry1Ac20 (Accession # ABB89046); Cry1Ac21 (Accession # AAY66992); Cry1Ac22 (Accession # ABZ01836); Cry1Ac23 (Accession # CAQ30431); Cry1Ac24 (Accession # ABL01535); Cry1Ac25 (Accession # FJ513324); Cry1Ac26 (Accession # FJ617446); Cry1Ac27 (Accession # FJ617447); Cry1Ac28 (Accession # ACM90319); Cry1Ac29 (Accession # DQ438941); Cry1Ac30 (Accession # GQ227507); Cry1Ac31 (Accession # GU446674); Cry1Ac32 (Accession # HM061081); Cry1Ac33 (Accession # GQ866913); Cry1Ac34 (Accession # HQ230364); Cry1Ac35 (Accession # JF340157); Cry1Ac36 (Accession # JN387137); Cry1Ac37 (Accession # JQ317685); Cry1Ad1 (Accession # AAA22340); Cry1Ad2 (Accession # CAA01880); Cry1Ae1 (Accession # AAA22410); Cry1Af1 (Accession # AAB82749); Cry1Ag1 (Accession # AAD46137); Cry1Ah1 (Accession # AAQ14326); Cry1Ah2 (Accession # ABB76664); Cry1Ah3 (Accession # HQ439779); Cry1Ai1 (Accession # AAO39719); Cry1Ai2 (Accession # HQ439780); Cry1A-like (Accession # AAK14339); Cry1Ba1 (Accession # CAA29898); Cry1Ba2 (Accession # CAA65003); Cry1Ba3 (Accession # AAK63251); Cry1Ba4 (Accession # AAK51084); Cry1Ba5 (Accession # AB020894); Cry1Ba6 (Accession # ABL60921); Cry1Ba7 (Accession # HQ439781); Cry1Bb1 (Accession # AAA22344); Cry1Bb2 (Accession # HQ439782); Cry1Bc1 (Accession # CAA86568); Cry1Bd1 (Accession # AAD10292); Cry1Bd2 (Accession # AAM93496); Cry1Be1 (Accession # AAC32850); Cry1Be2 (Accession # AAQ52387); Cry1Be3 (Accession # ACV96720); Cry1Be4 (Accession # HM070026); Cry1Bf1 (Accession # CAC50778); Cry1Bf2 (Accession # AAQ52380); Cry1Bg1 (Accession # AAO39720); Cry1Bh1 (Accession # HQ589331); Cry1Bi1 (Accession # KC156700); Cry1Ca1 (Accession # CAA30396); Cry1Ca2 (Accession # CAA31951); Cry1Ca3 (Accession # AAA22343); Cry1Ca4 (Accession # CAA01886); Cry1Ca5 (Accession # CAA65457); Cry1Ca6 [1] (Accession # AAF37224); Cry1Ca7 (Accession # AAG50438); Cry1Ca8 (Accession # AAM00264); Cry1Ca9 (Accession # AAL79362); Cry1Ca10 (Accession # AAN16462); Cry1Ca11 (Accession # AAX53094); Cry1Ca12 (Accession # HM070027); Cry1Ca13 (Accession # HQ412621); Cry1Ca14 (Accession # JN651493); Cry1Cb (Accession # M97880); Cry1Cb2 (Accession # AAG35409); Cry1Cb3 (Accession # ACD50894); Cry1Cb-like (Accession # AAX63901); Cry1Da1 (Accession # CAA38099); Cry1Da2 (Accession # I76415); Cry1Da3 (Accession # HQ439784); Cry1Db1 (Accession # CAA80234); Cry1Db2 (Accession # AAK48937); Cry1Dc1 (Accession # ABK35074); Cry1Ea1 (Accession # CAA37933); Cry1Ea2 (Accession # CAA39609); Cry1Ea3 (Accession # AAA22345); Cry1Ea4 (Accession # AAD04732); Cry1Ea5 (Accession # A15535); Cry1Ea6 (Accession # AAL50330); Cry1Ea7 (Accession # AAW72936); Cry1Ea8 (Accession # ABX11258); Cry1Ea9 (Accession # HQ439785); Cry1Ea10 (Accession # ADR00398); Cry1Ea11 (Accession # JQ652456); Cry1Eb1 (Accession # AAA22346); Cry1Fa1 (Accession # AAA22348); Cry1Fa2 (Accession # AAA22347); Cry1Fa3 (Accession # HM070028); Cry1Fa4 (Accession # HM439638); Cry1Fb1 (Accession # CAA80235); Cry1Fb2 (Accession # BAA25298); Cry1Fb3 (Accession # AAF21767); Cry1Fb4 (Accession # AAC10641); Cry1Fb5 (Accession # AAO13295); Cry1Fb6 (Accession # ACD50892); Cry1Fb7 (Accession # ACD50893); Cry1Ga1 (Accession # CAA80233); Cry1Ga2 (Accession # CAA70506); Cry1Gb1 (Accession # AAD10291); Cry1Gb2 (Accession # AAO13756); Cry1Gc1 (Accession # AAQ52381); Cry1Ha1 (Accession # CAA80236); Cry1Hb1 (Accession # AAA79694); Cry1Hb2 (Accession # HQ439786); Cry1H-like (Accession # AAF01213); Cry1Ia1 (Accession # CAA44633); Cry1Ia2 (Accession # AAA22354); Cry1Ia3 (Accession # AAC36999); Cry1Ia4 (Accession # AAB00958); Cry1Ia5 (Accession # CAA70124); Cry1Ia6 (Accession # AAC26910); Cry1Ia7 (Accession # AAM73516); Cry1Ia8 (Accession # AAK66742); Cry1Ia9 (Accession # AAQ08616); Cry1Ia10 (Accession # AAP86782); Cry1Ia11 (Accession # CAC85964); Cry1Ia12 (Accession # AAV53390); Cry1Ia13 (Accession # ABF83202); Cry1Ia14 (Accession # ACG63871); Cry1Ia15 (Accession # FJ617445); Cry1Ia16 (Accession # FJ617448); Cry1Ia17 (Accession # GU989199); Cry1Ia18 (Accession # ADK23801); Cry1Ia19 (Accession # HQ439787); Cry1Ia20 (Accession # JQ228426); Cry1Ia21 (Accession # JQ228424); Cry1Ia22 (Accession # JQ228427); Cry1Ia23 (Accession #

JQ228428); Cry1Ia24 (Accession # JQ228429); Cry1Ia25 (Accession # JQ228430); Cry1Ia26 (Accession # JQ228431); Cry1Ia27 (Accession # JQ228432); Cry1Ia28 (Accession # JQ228433); Cry1Ia29 (Accession # JQ228434); Cry1Ia30 (Accession # JQ317686); Cry1Ia31 (Accession # JX944038); Cry1Ia32 (Accession # JX944039); Cry1Ia33 (Accession # JX944040); Cry1Ib1 (Accession # AAA82114); Cry1Ib2 (Accession # ABW88019); Cry1Ib3 (Accession # ACD75515); Cry1Ib4 (Accession # HM051227); Cry1Ib5 (Accession # HM070028); Cry1Ib6 (Accession # ADK38579); Cry1Ib7 (Accession # JN571740); Cry1Ib8 (Accession # JN675714); Cry1Ib9 (Accession # JN675715); Cry1Ib10 (Accession # JN675716); Cry1Ib11 (Accession # JQ228423); Cry1Ic1 (Accession # AAC62933); Cry1Ic2 (Accession # AAE71691); Cry1Id1 (Accession # AAD44366); Cry1Id2 (Accession # JQ228422); Cry1Ie1 (Accession # AAG43526); Cry1Ie2 (Accession # HM439636); Cry1Ie3 (Accession # KC156647); Cry1Ie4 (Accession # KC156681); Cry1If1 (Accession # AAQ52382); Cry1Ig1 (Accession # KC156701); Cry1I-like (Accession # AAC31094); Cry1I-like (Accession # ABG88859); Cry1Ja1 (Accession # AAA22341); Cry1Ja2 (Accession # HM070030); Cry1Ja3 (Accession # JQ228425); Cry1Jb1 (Accession # AAA98959); Cry1Jc1 (Accession # AAC31092); Cry1Jc2 (Accession # AAQ52372); Cry1Jd1 (Accession # CAC50779); Cry1Ka1 (Accession # AAB00376); Cry1Ka2 (Accession # HQ439783); Cry1La1 (Accession # AAS60191); Cry1La2 (Accession # HM070031); Cry1Ma1 (Accession # FJ884067); Cry1Ma2 (Accession # KC156659); Cry1Na1 (Accession # KC156648); Cry1Nb1 (Accession # KC156678); Cry1-like (Accession # AAC31091); Cry2Aa1 (Accession # AAA22335); Cry2Aa2 (Accession # AAA83516); Cry2Aa3 (Accession # D86064); Cry2Aa4 (Accession #AAC04867); Cry2Aa5 (Accession # CAA10671); Cry2Aa6 (Accession # CAA10672); Cry2Aa7 (Accession # CAA10670); Cry2Aa8 (Accession # AAO13734); Cry2Aa9 (Accession # AAO13750); Cry2Aa10 (Accession # AAQ04263); Cry2Aa11 (Accession # AAQ52384); Cry2Aa12 (Accession # AB183671); Cry2Aa13 (Accession # ABL01536); Cry2Aa14 (Accession # ACF04939); Cry2Aa15 (Accession # JN426947); Cry2Ab1 (Accession # AAA22342); Cry2Ab2 (Accession # CAA39075); Cry2Ab3 (Accession # AAG36762); Cry2Ab4 (Accession # AAO13296); Cry2Ab5 (Accession # AAQ04609); Cry2Ab6 (Accession # AAP59457); Cry2Ab7 (Accession # AAZ66347); Cry2Ab8 (Accession # ABC95996); Cry2Ab9 (Accession # ABC74968); Cry2Ab10 (Accession # EF157306); Cry2Ab11 (Accession # CAM84575); Cry2Ab12 (Accession # ABM21764); Cry2Ab13 (Accession # ACG76120); Cry2Ab14 (Accession # ACG76121); Cry2Ab15 (Accession # HM037126); Cry2Ab16 (Accession # GQ866914); Cry2Ab17 (Accession # HQ439789); Cry2Ab18 (Accession # JN135255); Cry2Ab19 (Accession # JN135256); Cry2Ab20 (Accession # JN135257); Cry2Ab21 (Accession # JN135258); Cry2Ab22 (Accession # JN135259); Cry2Ab23 (Accession # JN135260); Cry2Ab24 (Accession # JN135261); Cry2Ab25 (Accession # JN415485); Cry2Ab26 (Accession # JN426946); Cry2Ab27 (Accession # JN415764); Cry2Ab28 (Accession # JN651494); Cry2Ac1 (Accession # CAA40536); Cry2Ac2 (Accession # AAG35410); Cry2Ac3 (Accession # AAQ52385); Cry2Ac4 (Accession # ABC95997); Cry2Ac5 (Accession # ABC74969); Cry2Ac6 (Accession # ABC74793); Cry2Ac7 (Accession # CAL18690); Cry2Ac8 (Accession # CAM09325); Cry2Ac9 (Accession # CAM09326); Cry2Ac10 (Accession # ABN15104); Cry2Ac11 (Accession # CAM83895); Cry2Ac12 (Accession # CAM83896); Cry2Ad1 (Accession # AAF09583); Cry2Ad2 (Accession # ABC86927); Cry2Ad3 (Accession # CAK29504); Cry2Ad4 (Accession # CAM32331); Cry2Ad5 (Accession # CA078739); Cry2Ae1 (Accession # AAQ52362); Cry2Af1 (Accession # AB030519); Cry2Af2 (Accession # GQ866915); Cry2Ag1 (Accession # ACH91610); Cry2Ah1 (Accession # EU939453); Cry2Ah2 (Accession # ACL80665); Cry2Ah3 (Accession # GU073380); Cry2Ah4 (Accession # KC156702); Cry2Ai1 (Accession # FJ788388); Cry2Aj (Accession #); Cry2Ak1 (Accession # KC156660); Cry2Ba1 (Accession # KC156658); Cry3Aa1 (Accession # AAA22336); Cry3Aa2 (Accession # AAA22541); Cry3Aa3 (Accession # CAA68482); Cry3Aa4 (Accession # AAA22542); Cry3Aa5 (Accession # AAA50255); Cry3Aa6 (Accession # AAC43266); Cry3Aa7 (Accession # CAB41411); Cry3Aa8 (Accession # AAS79487); Cry3Aa9 (Accession # AAW05659); Cry3Aa10 (Accession # AAU29411); Cry3Aa11 (Accession # AAW82872); Cry3Aa12 (Accession # ABY49136); Cry3Ba1 (Accession # CAA34983); Cry3Ba2 (Accession # CAA00645); Cry3Ba3 (Accession # JQ397327); Cry3Bb1 (Accession # AAA22334); Cry3Bb2 (Accession # AAA74198); Cry3Bb3 (Accession # I15475); Cry3Ca1 (Accession # CAA42469); Cry4Aa1 (Accession # CAA68485); Cry4Aa2 (Accession # BAA00179); Cry4Aa3 (Accession # CAD30148); Cry4Aa4 (Accession # AFB18317); Cry4A-like (Accession # AAY96321); Cry4Ba1 (Accession # CAA30312); Cry4Ba2 (Accession # CAA30114); Cry4Ba3 (Accession # AAA22337); Cry4Ba4 (Accession # BAA00178); Cry4Ba5 (Accession # CAD30095); Cry4Ba-like (Accession # ABC47686); Cry4Ca1 (Accession # EU646202); Cry4Cb1 (Accession # FJ403208); Cry4Cb2 (Accession # FJ597622); Cry4Cc1 (Accession # FJ403207); Cry5Aa1 (Accession # AAA67694); Cry5Ab1 (Accession # AAA67693); Cry5Ac1 (Accession # I34543); Cry5Ad1 (Accession # ABQ82087); Cry5Ba1 (Accession # AAA68598); Cry5Ba2 (Accession # ABW88931); Cry5Ba3 (Accession # AFJ04417); Cry5Ca1 (Accession # HM461869); Cry5Ca2 (Accession # ZP_04123426); Cry5Da1 (Accession # HM461870); Cry5Da2 (Accession # ZP_04123980); Cry5Ea1 (Accession # HM485580); Cry5Ea2 (Accession # ZP_04124038); Cry6Aa1 (Accession # AAA22357); Cry6Aa2 (Accession # AAM46849); Cry6Aa3 (Accession # ABH03377); Cry6Ba1 (Accession # AAA22358); Cry7Aa1 (Accession # AAA22351); Cry7Ab1 (Accession # AAA21120); Cry7Ab2 (Accession # AAA21121); Cry7Ab3 (Accession # ABX24522); Cry7Ab4 (Accession # EU380678); Cry7Ab5 (Accession # ABX79555); Cry7Ab6 (Accession # AC144005); Cry7Ab7 (Accession # ADB89216); Cry7Ab8 (Accession # GU145299); Cry7Ab9 (Accession # ADD92572); Cry7Ba1 (Accession # ABB70817); Cry7Bb1 (Accession # KC156653); Cry7Ca1 (Accession # ABR67863); Cry7Cb1 (Accession # KC156698); Cry7Da1 (Accession # ACQ99547); Cry7Da2 (Accession # HM572236); Cry7Da3 (Accession # KC156679); Cry7Ea1 (Accession # HM035086); Cry7Ea2 (Accession # HM132124); Cry7Ea3 (Accession # EEM19403); Cry7Fa1 (Accession # HM035088); Cry7Fa2 (Accession # EEM19090); Cry7Fb1 (Accession # HM572235); Cry7Fb2 (Accession # KC156682); Cry7Ga1 (Accession # HM572237); Cry7Ga2 (Accession # KC156669); Cry7Gb1 (Accession # KC156650); Cry7Gc1 (Accession # KC156654); Cry7Gd1 (Accession # KC156697); Cry7Ha1 (Accession # KC156651); Cry7Ia1 (Accession # KC156665); Cry7Ja1

(Accession # KC156671); Cry7Ka1 (Accession # KC156680); Cry7Kb1 (Accession # BAM99306); Cry7La1 (Accession # BAM99307); Cry8Aa1 (Accession # AAA21117); Cry8Ab1 (Accession # EU044830); Cry8Ac1 (Accession # KC156662); Cry8Ad1 (Accession # KC156684); Cry8Ba1 (Accession # AAA21118); Cry8Bb1 (Accession # CAD57542); Cry8Bc1 (Accession # CAD57543); Cry8Ca1 (Accession # AAA21119); Cry8Ca2 (Accession # AAR98783); Cry8Ca3 (Accession # EU625349); Cry8Ca4 (Accession # ADB54826); Cry8Da1 (Accession # BAC07226); Cry8Da2 (Accession # BD133574); Cry8Da3 (Accession # BD133575); Cry8Db1 (Accession # BAF93483); Cry8Ea1 (Accession # AAQ73470); Cry8Ea2 (Accession # EU047597); Cry8Ea3 (Accession # KC855216); Cry8Fa1 (Accession # AAT48690); Cry8Fa2 (Accession # HQ174208); Cry8Fa3 (Accession # AFH78109); Cry8Ga1 (Accession # AAT46073); Cry8Ga2 (Accession # ABC42043); Cry8Ga3 (Accession # FJ198072); Cry8Ha1 (Accession # AAW81032); Cry8Ia1 (Accession # EU381044); Cry8Ia2 (Accession # GU073381); Cry8Ia3 (Accession # HM044664); Cry8Ia4 (Accession # KC156674); Cry8Ib1 (Accession # GU325772); Cry8Ib2 (Accession # KC156677); Cry8Ja1 (Accession # EU625348); Cry8Ka1 (Accession # FJ422558); Cry8Ka2 (Accession # ACN87262); Cry8Kb1 (Accession # HM123758); Cry8Kb2 (Accession # KC156675); Cry8La1 (Accession # GU325771); Cry8Ma1 (Accession # HM044665); Cry8Ma2 (Accession # EEM86551); Cry8Ma3 (Accession # HM210574); Cry8Na1 (Accession # HM640939); Cry8Pa1 (Accession # HQ388415); Cry8Qa1 (Accession # HQ441166); Cry8Qa2 (Accession # KC152468); Cry8Ra1 (Accession # AFP87548); Cry8Sa1 (Accession # JQ740599); Cry8Ta1 (Accession # KC156673); Cry8-like (Accession # FJ770571); Cry8-like (Accession # ABS53003); Cry9Aa1 (Accession # CAA41122); Cry9Aa2 (Accession # CAA41425); Cry9Aa3 (Accession # GQ249293); Cry9Aa4 (Accession # GQ249294); Cry9Aa5 (Accession # JX174110); Cry9Aa like (Accession # AAQ52376); Cry9Ba1 (Accession # CAA52927); Cry9Ba2 (Accession # GU299522); Cry9Bb1 (Accession # AAV28716); Cry9Ca1 (Accession # CAA85764); Cry9Ca2 (Accession # AAQ52375); Cry9Da1 (Accession # BAA19948); Cry9Da2 (Accession # AAB97923); Cry9Da3 (Accession # GQ249293); Cry9Da4 (Accession # GQ249297); Cry9Db1 (Accession # AAX78439); Cry9Dc1 (Accession # KC156683); Cry9Ea1 (Accession # BAA34908); Cry9Ea2 (Accession # AAO12908); Cry9Ea3 (Accession # ABM21765); Cry9Ea4 (Accession # ACE88267); Cry9Ea5 (Accession # ACF04743); Cry9Ea6 (Accession # ACG63872); Cry9Ea7 (Accession # FJ380927); Cry9Ea8 (Accession # GQ249292); Cry9Ea9 (Accession # JN651495); Cry9Eb1 (Accession # CAC50780); Cry9Eb2 (Accession # GQ249298); Cry9Eb3 (Accession # KC156646); Cry9Ec1 (Accession # AAC63366); Cry9Ed1 (Accession # AAX78440); Cry9Ee1 (Accession # GQ249296); Cry9Ee2 (Accession # KC156664); Cry9Fa1 (Accession # KC156692); Cry9Ga1 (Accession # KC156699); Cry9-like (Accession # AAC63366); Cry10Aa1 (Accession # AAA22614); Cry10Aa2 (Accession # E00614); Cry10Aa3 (Accession # CAD30098); Cry10Aa4 (Accession # AFB18318); Cry10A-like (Accession # DQ167578); Cry11Aa1 (Accession # AAA22352); Cry11Aa2 (Accession # AAA22611); Cry11Aa3 (Accession # CAD30081); Cry11Aa4 (Accession # AFB18319); Cry11Aa-like (Accession # DQ166531); Cry11Ba1 (Accession # CAA60504); Cry11Bb1 (Accession # AAC97162); Cry11Bb2 (Accession # HM068615); Cry12Aa1 (Accession # AAA22355); Cry13Aa1 (Accession # AAA22356); Cry14Aa1 (Accession # AAA21516); Cry14Ab1 (Accession # KC156652); Cry15Aa1 (Accession # AAA22333); Cry16Aa1 (Accession # CAA63860); Cry17Aa1 (Accession # CAA67841); Cry18Aa1 (Accession # CAA67506); Cry18Ba1 (Accession # AAF89667); Cry18Ca1 (Accession # AAF89668); Cry19Aa1 (Accession # CAA68875); Cry19Ba1 (Accession # BAA32397); Cry19Ca1 (Accession # AFM37572); Cry20Aa1 (Accession # AAB93476); Cry20Ba1 (Accession # ACS93601); Cry20Ba2 (Accession # KC156694); Cry20-like (Accession # GQ144333); Cry21Aa1 (Accession # I32932); Cry21Aa2 (Accession # I66477); Cry21Ba1 (Accession # BAC06484); Cry21Ca1 (Accession # JF521577); Cry21Ca2 (Accession # KC156687); Cry21Da1 (Accession # JF521578); Cry22Aa1 (Accession # I34547); Cry22Aa2 (Accession # CAD43579); Cry22Aa3 (Accession # ACD93211); Cry22Ab1 (Accession # AAK50456); Cry22Ab2 (Accession # CAD43577); Cry22Ba1 (Accession # CAD43578); Cry22Bb1 (Accession # KC156672); Cry23Aa1 (Accession # AAF76375); Cry24Aa1 (Accession # AAC61891); Cry24Ba1 (Accession # BAD32657); Cry24Ca1 (Accession # CAJ43600); Cry25Aa1 (Accession # AAC61892); Cry26Aa1 (Accession # AAD25075); Cry27Aa1 (Accession # BAA82796); Cry28Aa1 (Accession # AAD24189); Cry28Aa2 (Accession # AAG00235); Cry29Aa1 (Accession # CAC80985); Cry30Aa1 (Accession # CAC80986); Cry30Ba1 (Accession # BAD00052); Cry30Ca1 (Accession # BAD67157); Cry30Ca2 (Accession # ACU24781); Cry30Da1 (Accession # EF095955); Cry30Db1 (Accession # BAE80088); Cry30Ea1 (Accession # ACC95445); Cry30Ea2 (Accession # FJ499389); Cry30Fa1 (Accession # AC122625); Cry30Ga1 (Accession # ACG60020); Cry30Ga2 (Accession # HQ638217); Cry31Aa1 (Accession # BAB11757); Cry31Aa2 (Accession # AAL87458); Cry31Aa3 (Accession # BAE79808); Cry31Aa4 (Accession # BAF32571); Cry31Aa5 (Accession # BAF32572); Cry31Aa6 (Accession # BAI44026); Cry31Ab1 (Accession # BAE79809); Cry31Ab2 (Accession # BAF32570); Cry31Ac1 (Accession # BAF34368); Cry31Ac2 (Accession # AB731600); Cry31Ad1 (Accession # BAI44022); Cry32Aa1 (Accession # AAG36711); Cry32Aa2 (Accession # GU063849); Cry32Ab1 (Accession # GU063850); Cry32Ba1 (Accession # BAB78601); Cry32Ca1 (Accession # BAB78602); Cry32Cb1 (Accession # KC156708); Cry32Da1 (Accession # BAB78603); Cry32Ea1 (Accession # GU324274); Cry32Ea2 (Accession # KC156686); Cry32Eb1 (Accession # KC156663); Cry32Fa1 (Accession # KC156656); Cry32Ga1 (Accession # KC156657); Cry32Ha1 (Accession # KC156661); Cry32Hb1 (Accession # KC156666); Cry32Ia1 (Accession # KC156667); Cry32Ja1 (Accession # KC156685); Cry32Ka1 (Accession # KC156688); Cry32La1 (Accession # KC156689); Cry32Ma1 (Accession # KC156690); Cry32Mb1 (Accession # KC156704); Cry32Na1 (Accession # KC156691); Cry32Oa1 (Accession # KC156703); Cry32Pa1 (Accession # KC156705); Cry32Qa1 (Accession # KC156706); Cry32Ra1 (Accession # KC156707); Cry32Sa1 (Accession # KC156709); Cry32Ta1 (Accession # KC156710); Cry32Ua1 (Accession # KC156655); Cry33Aa1 (Accession # AAL26871); Cry34Aa1 (Accession # AAG50341); Cry34Aa2 (Accession # AAK64560); Cry34Aa3 (Accession # AAT29032); Cry34Aa4 (Accession # AAT29030); Cry34Ab1 (Accession # AAG41671); Cry34Ac1 (Accession # AAG50118); Cry34Ac2 (Accession # AAK64562); Cry34Ac3 (Accession # AAT29029); Cry34Ba1 (Accession # AAK64565);

Cry34Ba2 (Accession # AAT29033); Cry34Ba3 (Accession # AAT29031); Cry35Aa1 (Accession # AAG50342); Cry35Aa2 (Accession # AAK64561); Cry35Aa3 (Accession # AAT29028); Cry35Aa4 (Accession # AAT29025); Cry35Ab1 (Accession # AAG41672); Cry35Ab2 (Accession # AAK64563); Cry35Ab3 (Accession # AY536891); Cry35Ac1 (Accession # AAG50117); Cry35Ba1 (Accession # AAK64566); Cry35Ba2 (Accession # AAT29027); Cry35Ba3 (Accession # AAT29026); Cry36Aa1 (Accession # AAK64558); Cry37Aa1 (Accession # AAF76376); Cry38Aa1 (Accession # AAK64559); Cry39Aa1 (Accession # BAB72016); Cry40Aa1 (Accession # BAB72018); Cry40Ba1 (Accession # BAC77648); Cry40Ca1 (Accession # EU381045); Cry40Da1 (Accession # ACF15199); Cry41Aa1 (Accession # BAD35157); Cry41Ab1 (Accession # BAD35163); Cry41Ba1 (Accession # HM461871); Cry41Ba2 (Accession # ZP_04099652); Cry42Aa1 (Accession # BAD35166); Cry43Aa1 (Accession # BAD15301); Cry43Aa2 (Accession # BAD95474); Cry43Ba1 (Accession # BAD15303); Cry43Ca1 (Accession # KC156676); Cry43Cb1 (Accession # KC156695); Cry43Cc1 (Accession # KC156696); Cry43-like (Accession # BAD15305); Cry44Aa (Accession # BAD08532); Cry45Aa (Accession # BAD22577); Cry46Aa (Accession # BAC79010); Cry46Aa2 (Accession # BAG68906); Cry46Ab (Accession # BAD35170); Cry47Aa (Accession # AAY24695); Cry48Aa (Accession # CAJ18351); Cry48Aa2 (Accession # CAJ86545); Cry48Aa3 (Accession # CAJ86546); Cry48Ab (Accession # CAJ86548); Cry48Ab2 (Accession # CAJ86549); Cry49Aa (Accession # CAH56541); Cry49Aa2 (Accession # CAJ86541); Cry49Aa3 (Accession # CAJ86543); Cry49Aa4 (Accession # CAJ86544); Cry49Ab1 (Accession # CAJ86542); Cry50Aa1 (Accession # BAE86999); Cry50Ba1 (Accession # GU446675); Cry50Ba2 (Accession # GU446676); Cry51Aa1 (Accession # AB114444); Cry51Aa2 (Accession # GU570697); Cry52Aa1 (Accession # EF613489); Cry52Ba1 (Accession # FJ361760); Cry53Aa1 (Accession # EF633476); Cry53Ab1 (Accession # FJ361759); Cry54Aa1 (Accession #ACA52194); Cry54Aa2 (Accession # GQ140349); Cry54Ba1 (Accession # GU446677); Cry55Aa1 (Accession # ABW88932); Cry54Ab1 (Accession # JQ916908); Cry55Aa2 (Accession # AAE33526); Cry56Aa1 (Accession # ACU57499); Cry56Aa2 (Accession # GQ483512); Cry56Aa3 (Accession # JX025567); Cry57Aa1 (Accession # ANC87261); Cry58Aa1 (Accession # ANC87260); Cry59Ba1 (Accession # JN790647); Cry59Aa1 (Accession # ACR43758); Cry60Aa1 (Accession # ACU24782); Cry60Aa2 (Accession # EAO57254); Cry60Aa3 (Accession # EEM99278); Cry60Ba1 (Accession # GU810818); Cry60Ba2 (Accession # EAO57253); Cry60Ba3 (Accession # EEM99279); Cry61Aa1 (Accession # HM035087); Cry61Aa2 (Accession # HM132125); Cry61Aa3 (Accession # EEM19308); Cry62Aa1 (Accession # HM054509); Cry63Aa1 (Accession # BAI44028); Cry64Aa1 (Accession # BAJ05397); Cry65Aa1 (Accession # HM461868); Cry65Aa2 (Accession # ZP_04123838); Cry66Aa1 (Accession # HM485581); Cry66Aa2 (Accession # ZP_04099945); Cry67Aa1 (Accession # HM485582); Cry67Aa2 (Accession # ZP_04148882); Cry68Aa1 (Accession # HQ113114); Cry69Aa1 (Accession # HQ401006); Cry69Aa2 (Accession # JQ821388); Cry69Ab1 (Accession # JN209957); Cry70Aa1 (Accession # JN646781); Cry70Ba1 (Accession # ADO51070); Cry70Bb1 (Accession # EEL67276); Cry71Aa1 (Accession # JX025568); Cry72Aa1 (Accession # JX025569).

Examples of δ-endotoxins also include but are not limited to Cry1A proteins of U.S. Pat. Nos. 5,880,275 and 7,858,849; a DIG-3 or DIG-11 toxin (N-terminal deletion of α-helix 1 and/or α-helix 2 variants of Cry proteins such as Cry1A) of U.S. Pat. Nos. 8,304,604 and 8,304,605, Cry1B of U.S. patent application Ser. No. 10/525,318; Cry1C of U.S. Pat. No. 6,033,874; Cry1F of U.S. Pat. Nos. 5,188,960, 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,378,499 and 7,462,760; a Cry9 protein such as such as members of the Cry9A, Cry9B, Cry9C, Cry9D, Cry9E, and Cry9F families; a Cry15 protein of Naimov, et al., (2008) *Applied and Environmental Microbiology* 74:7145-7151; a Cry22, a Cry34Ab1 protein of U.S. Pat. Nos. 6,127,180, 6,624,145 and 6,340,593; a CryET33 and CryET34 protein of U.S. Pat. Nos. 6,248,535, 6,326,351, 6,399,330, 6,949,626, 7,385,107 and 7,504,229; a CryET33 and CryET34 homologs of US Patent Publication Numbers 2006/0191034, 2012/0278954, and PCT Publication Number WO 2012/139004; a Cry35Ab1 protein of U.S. Pat. Nos. 6,083,499, 6,548,291 and 6,340,593; a Cry46 protein, a Cry 51 protein, a Cry binary toxin; a TIC901 or related toxin; TIC807 of US 2008/0295207; ET29, ET37, TIC809, TIC810, TIC812, TIC127, TIC128 of PCT US 2006/033867; AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020, and AXMI-021 of WO 2006/083891; AXMI-010 of WO 2005/038032; AXMI-003 of WO 2005/021585; AXMI-008 of US 2004/0250311; AXMI-006 of US 2004/0216186; AXMI-007 of US 2004/0210965; AXMI-009 of US 2004/0210964; AXMI-014 of US 2004/0197917; AXMI-004 of US 2004/0197916; AXMI-028 and AXMI-029 of WO 2006/119457; AXMI-007, AXMI-008, AXMI-0080rf2, AXMI-009, AXMI-014 and AXMI-004 of WO 2004/074462; AXMI-150 of U.S. Pat. No. 8,084,416; AXMI-205 of US20110023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063, and AXMI-064 of US 2011/0263488; AXMI-R1 and related proteins of US 2010/0197592; AXMI221Z, AXMI222z, AXMI223z, AXMI224z and AXMI225z of WO 2011/103248; AXMI218, AXMI219, AXMI220, AXM1226, AXM1227, AXM1228, AXM1229, AXMI230, and AXMI231 of WO11/103247; AXMI-115, AXMI-113, AXMI-005, AXMI-163 and AXMI-184 of U.S. Pat. No. 8,334,431; AXMI-001, AXMI-002, AXMI-030, AXMI-035, and AXMI-045 of US 2010/0298211; AXMI-066 and AXMI-076 of US20090144852; AXM1128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI0092, AXMI096, AXMI0097, AXMI0098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI1257, AXMI1268, AXMI127, AXMI129, AXMI164, AXMI151, AXMI161, AXMI183, AXMI132, AXMI138, AXMI137 of US 2010/0005543; and Cry proteins such as Cry1A and Cry3A having modified proteolytic sites of U.S. Pat. No. 8,319,019; and a Cry1Ac, Cry2Aa and Cry1Ca toxin protein from *Bacillus thuringiensis* strain VBTS 2528 of US Patent Application Publication Number 2011/0064710. Other Cry proteins are well known to one skilled in the art (see, Crickmore, et al., "*Bacillus thuringiensis* toxin nomenclature" (2011), at lifesci.sussex.ac.uk/home/Neil_Crickmore/Bt/which can be accessed on the world-wide web using the "www" prefix). The insecticidal activity of Cry proteins is well known to one skilled in the art (for review, see, van Frannkenhuyzen, (2009) *J. Invert. Path.* 101:1-16). The use of Cry proteins as transgenic plant traits is well known to one skilled in the art and Cry-transgenic plants including but not limited to Cry1Ac, Cry1Ac+Cry2Ab, Cry1Ab, Cry1A.105, Cry1F, Cry1Fa2, Cry1F+Cry1Ac, Cry2Ab, Cry3A, mCry3A, Cry3Bb1, Cry34Ab1, Cry35Ab1, Vip3A, mCry3A, Cry9c and CBI-Bt have received regulatory approval (see, Sanahuja, (2011) *Plant Biotech Journal* 9:283-300 and the CERA (2010) GM Crop Database Center for Environmental Risk Assessment (CERA), ILSI Research Foundation, Washington D.C. at cera-gmc.org/index.php?action=gm_crop_database which can be accessed on the world-wide web using the "www" prefix). More than one pesticidal proteins well known to one skilled in the art can also be expressed in plants such as Vip3Ab & Cry1 Fa (US2012/0317682), Cry1BE & Cry1F (US2012/0311746), Cry1CA & Cry1AB (US2012/0311745), Cry1F & CryCa (US2012/0317681), Cry1 DA & Cry1BE (US2012/0331590), Cry1DA & Cry1Fa (US2012/0331589), Cry1AB & Cry1BE (US2012/0324606), and Cry1Fa & Cry2Aa, Cry1I or Cry1E (US2012/0324605). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279, 6,137,033, 7,244,820, 7,615,686, and 8,237,020, and the like. Other VIP proteins are well known to one skilled in the art (see, lifesci.sussex.ac.uk/home/Neil_Crickmore/Bt/vip.html which can be accessed on the world-wide web using the "www" prefix). Pesticidal proteins also include toxin complex (TC) proteins, obtainable from organisms such as *Xenorhabdus, Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but are not limited to lycotoxin-1 peptides and mutants thereof (U.S. Pat. No. 8,334,366).

(C) A polynucleotide encoding an insect-specific hormone or pheromone such as an ecdysteroid and juvenile hormone, a variant thereof, a mimetic based thereon or an antagonist or agonist thereof. See, for example, the disclosure by Hammock, et al., (1990) *Nature* 344:458, of baculovirus expression of cloned juvenile hormone esterase, an inactivator of juvenile hormone.

(D) A polynucleotide encoding an insect-specific peptide which, upon expression, disrupts the physiology of the affected pest. For example, see the disclosures of, Regan, (1994) *J. Biol. Chem.* 269:9 (expression cloning yields DNA coding for insect diuretic hormone receptor); Pratt, et al., (1989) *Biochem. Biophys. Res. Comm.* 163:1243 (an allostatin is identified in *Diploptera puntata*); Chattopadhyay, et al., (2004) *Critical Reviews in Microbiology* 30(1):33-54; Zjawiony, (2004) *J Nat Prod* 67(2):300-310; Carlini and Grossi-de-Sa, (2002) *Toxicon* 40(11):1515-1539; Ussuf, et al., (2001) *Curr Sci.* 80(7):847-853 and Vasconcelos and Oliveira, (2004) *Toxicon* 44(4):385-403. See also, U.S. Pat. No. 5,266,317 to Tomalski, et al., who disclose genes encoding insect-specific toxins.

(E) A polynucleotide encoding an enzyme responsible for a hyperaccumulation of a monoterpene, a sesquiterpene, a steroid, hydroxamic acid, a phenylpropanoid derivative or another non-protein molecule with insecticidal activity.

(F) A polynucleotide encoding an enzyme involved in the modification, including the post-translational modification, of a biologically active molecule; for example, a glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic. See, PCT Application WO 1993/02197 in the name of Scott, et al., which discloses the nucleotide sequence of a callase gene. DNA molecules which contain chitinase-encoding sequences can be obtained, for example, from the ATCC® under Accession Numbers 39637 and 67152. See also, Kramer, et al., (1993) *Insect Biochem. Molec. Biol.* 23:691, who teach the nucleotide sequence of a cDNA encoding tobacco hookworm chitinase and Kawalleck, et al., (1993) *Plant Molec. Biol.* 21:673, who provide the nucleotide sequence of the parsley ubi4-2 polyubiquitin gene, and U.S. Pat. Nos. 6,563,020; 7,145,060 and 7,087,810.

(G) A polynucleotide encoding a molecule that stimulates signal transduction. For example, see the disclosure by Botella, et al., (1994) *Plant Molec. Biol.* 24:757, of nucleotide sequences for mung bean calmodulin cDNA clones, and Griess, et al., (1994) *Plant Physiol.* 104:1467, who provide the nucleotide sequence of a maize calmodulin cDNA clone.

(H) A polynucleotide encoding a hydrophobic moment peptide. See, PCT Application WO 1995/16776 and U.S. Pat. No. 5,580,852 disclosure of peptide derivatives of Tachyplesin which inhibit fungal plant pathogens) and PCT Application WO 1995/18855 and U.S. Pat. No. 5,607,914 (teaches synthetic antimicrobial peptides that confer disease resistance).

(I) A polynucleotide encoding a membrane permease, a channel former or a channel blocker. For example, see the disclosure by Jaynes, et al., (1993) *Plant Sci.* 89:43, of heterologous expression of a cecropin-beta lytic peptide analog to render transgenic tobacco plants resistant to *Pseudomonas solanacearum.*

(J) A gene encoding a viral-invasive protein or a complex toxin derived therefrom. For example, the accumulation of viral coat proteins in transformed plant cells imparts resistance to viral infection and/or disease development effected by the virus from which the coat protein gene is derived, as well as by related viruses. See, Beachy, et al., (1990) *Ann. Rev. Phytopathol.* 28:451. Coat protein-mediated resistance has been conferred upon transformed plants against alfalfa mosaic virus, cucumber mosaic virus, tobacco streak virus, potato virus X, potato virus Y, tobacco etch virus, tobacco rattle virus and tobacco mosaic virus. Id.

(K) A gene encoding an insect-specific antibody or an immunotoxin derived therefrom. Thus, an antibody targeted to a critical metabolic function in the insect gut would inactivate an affected enzyme, killing the insect. Cf. Taylor, et al., Abstract #497, SEVENTH INT'L SYMPOSIUM ON MOLECULAR PLANT-MICROBE INTERACTIONS (Edinburgh, Scotland, 1994) (enzymatic inactivation in transgenic tobacco via production of single-chain antibody fragments).

(L) A gene encoding a virus-specific antibody. See, for example, Tavladoraki, et al., (1993) *Nature* 366:469, who show that transgenic plants expressing recombinant antibody genes are protected from virus attack.

(M) A polynucleotide encoding a developmental-arrestive protein produced in nature by a pathogen or a parasite. Thus, fungal endo alpha-1,4-D-polygalacturonases facilitate fungal colonization and plant nutrient release by solubilizing plant cell wall homo-alpha-1,4-D-galacturonase. See, Lamb, et al., (1992) *Bio/Technology* 10:1436. The cloning and characterization of a gene which encodes a bean endopolygalacturonase-inhibiting protein is described by Toubart, et al., (1992) *Plant J.* 2:367.

(N) A polynucleotide encoding a developmental-arrestive protein produced in nature by a plant. For example, Logemann, et al., (1992) *Bio/Technology* 10:305, have shown that transgenic plants expressing the barley ribosome-inactivating gene have an increased resistance to fungal disease.

(O) Genes involved in the Systemic Acquired Resistance (SAR) Response and/or the pathogenesis related genes. Briggs, (1995) *Current Biology* 5(2), Pieterse and Van Loon, (2004) *Curr. Opin. Plant Bio.* 7(4):456-64 and Somssich, (2003) *Cell* 113(7):815-6.

(P) Antifungal genes (Cornelissen and Melchers, (1993) *Pl. Physiol.* 101:709-712 and Parijs, et al., (1991) *Planta* 183: 258-264 and Bushnell, et al., (1998) *Can. J. of Plant Path.* (2):137-149. Also see, U.S. patent application Ser. Nos. 09/950,933; 11/619,645; 11/657,710; 11/748,994; 11/774,121 and U.S. Pat. Nos. 6,891,085 and 7,306,946. LysM Receptor-like kinases for the perception of chitin fragments as a first step in plant defense response against fungal pathogens (US 2012/0110696).

(Q) Detoxification genes, such as for fumonisin, beauvericin, moniliformin and zearalenone and their structurally related derivatives. For example, see, U.S. Pat. Nos. 5,716,820; 5,792,931; 5,798,255; 5,846,812; 6,083,736; 6,538,177; 6,388,171 and 6,812,380.

(R) A polynucleotide encoding a Cystatin and cysteine proteinase inhibitors. See, U.S. Pat. No. 7,205,453.

(S) Defensin genes. See, WO 2003/000863 and U.S. Pat. Nos. 6,911,577; 6,855,865; 6,777,592 and 7,238,781.

(T) Genes conferring resistance to nematodes. See, e.g., PCT Application WO 1996/30517; PCT Application WO 1993/19181, WO 2003/033651 and Urwin, et al., (1998) *Planta* 204:472-479, Williamson, (1999) *Curr Opin Plant Bio.* 2(4):327-31; U.S. Pat. Nos. 6,284,948 and 7,301,069 and miR164 genes (WO 2012/058266).

(U) Genes that confer resistance to *Phytophthora* Root Rot, such as the Rps 1, Rps 1-a, Rps 1-b, Rps 1-c, Rps 1-d, Rps 1-e, Rps 1-k, Rps 2, Rps 3-a, Rps 3-b, Rps 3-c, Rps 4, Rps 5, Rps 6, Rps 7 and other Rps genes. See, for example, Shoemaker, et al., *Phytophthora* Root Rot Resistance Gene Mapping in Soybean, Plant Genome IV Conference, San Diego, Calif. (1995).

(V) Genes that confer resistance to Brown Stem Rot, such as described in U.S. Pat. No. 5,689,035 and incorporated by reference for this purpose.

(W) Genes that confer resistance to *Colletotrichum*, such as described in US Patent Application Publication US 2009/0035765 and incorporated by reference for this purpose. This includes the Rcg locus that may be utilized as a single locus conversion.

2. Transgenes that Confer Resistance to a Herbicide, for Example:

(A) A polynucleotide encoding resistance to a herbicide that inhibits the growing point or meristem, such as an imidazolinone or a sulfonylurea. Exemplary genes in this category code for mutant ALS and AHAS enzyme as described, for example, by Lee, et al., (1988) *EMBO J.* 7:1241 and Miki, et al., (1990) *Theor. Appl. Genet.* 80:449, respectively. See also, U.S. Pat. Nos. 5,605,011; 5,013,659; 5,141,870; 5,767,361; 5,731,180; 5,304,732; 4,761,373; 5,331,107; 5,928,937 and 5,378,824; U.S. patent application Ser. No. 11/683,737 and International Publication WO 1996/33270.

(B) A polynucleotide encoding a protein for resistance to Glyphosate (resistance imparted by mutant 5-enolpyruvl-3-phosphikimate synthase (EPSP) and aroA genes, respectively) and other phosphono compounds such as glufosinate (phosphinothricin acetyl transferase (PAT) and *Streptomyces hygroscopicus* phosphinothricin acetyl transferase (bar) genes), and pyridinoxy or phenoxy proprionic acids and cyclohexones (ACCase inhibitor-encoding genes). See, for example, U.S. Pat. No. 4,940,835 to Shah, et al., which discloses the nucleotide sequence of a form of EPSPS which can confer glyphosate resistance. U.S. Pat. No. 5,627,061 to Barry, et al., also describes genes encoding EPSPS enzymes. See also, U.S. Pat. Nos. 6,566,587; 6,338,961; 6,248,876 B1; 6,040,497; 5,804,425; 5,633,435; 5,145,783; 4,971,908; 5,312,910; 5,188,642; 5,094,945, 4,940,835; 5,866,775; 6,225,114 B1; 6,130,366; 5,310,667; 4,535,060; 4,769,061; 5,633,448; 5,510,471; Re. 36,449; RE 37,287 E and U.S. Pat. No. 5,491,288 and International Publications EP 1173580; WO 2001/66704; EP 1173581 and EP 1173582, which are incorporated herein by reference for this purpose. Glyphosate resistance is also imparted to plants that express a gene encoding a glyphosate oxido-reductase enzyme as described more fully in U.S. Pat. Nos. 5,776,760 and 5,463,175, which are incorporated herein by reference for this purpose. In addition glyphosate resistance can be imparted to plants by the over expression of genes encoding glyphosate N-acetyltransferase. See, for example, U.S. Pat. Nos. 7,462,481; 7,405,074 and US Patent Application Publication Number US 2008/0234130. A DNA molecule encoding a mutant aroA gene can be obtained under ATCC® Accession Number 39256, and the nucleotide sequence of the mutant gene is disclosed in U.S. Pat. No. 4,769,061 to Comai. EP Application Number 0 333 033 to Kumada, et al., and U.S. Pat. No. 4,975,374 to Goodman, et al., disclose nucleotide sequences of glutamine synthetase genes which confer resistance to herbicides such as L-phosphinothricin. The nucleotide sequence of a phosphinothricin-acetyl-transferase gene is provided in EP Application Numbers 0 242 246 and 0 242 236 to Leemans, et al., De Greef, et al., (1989) *Bio/Technology* 7:61, describe the production of transgenic plants that express chimeric bar genes coding for phosphinothricin acetyl transferase activity. See also, U.S. Pat. Nos. 5,969,213; 5,489,520; 5,550,318; 5,874,265; 5,919,675; 5,561,236; 5,648,477; 5,646,024; 6,177,616 B1 and 5,879,903, which are incorporated herein by reference for this purpose.

Exemplary genes conferring resistance to phenoxy proprionic acids and cyclohexones, such as sethoxydim and haloxyfop, are the Acc1-S1, Acc1-S2 and Acc1-S3 genes described by Marshall, et al., (1992) *Theor. Appl. Genet.* 83:435.

(C) A polynucleotide encoding a protein for resistance to herbicide that inhibits photosynthesis, such as a triazine (psbA and gs+ genes) and a benzonitrile (nitrilase gene). Przibilla, et al., (1991) Plant Cell 3:169, describe the transformation of *Chlamydomonas* with plasmids encoding mutant psbA genes. Nucleotide sequences for nitrilase genes are disclosed in U.S. Pat. No. 4,810,648 to Stalker and DNA molecules containing these genes are available under ATCC® Accession Numbers 53435, 67441 and 67442. Cloning and expression of DNA coding for a glutathione S-transferase is described by Hayes, et al., (1992) *Biochem. J.* 285:173.

(D) A polynucleotide encoding a protein for resistance to Acetohydroxy acid synthase, which has been found to make plants that express this enzyme resistant to multiple types of herbicides, has been introduced into a variety of plants (see, e.g., Hattori, et al., (1995) *Mol Gen Genet.* 246:419). Other genes that confer resistance to herbicides include: a gene encoding a chimeric protein of rat cytochrome P4507A1 and yeast NADPH-cytochrome P450 oxidoreductase (Shiota, et al., (1994) *Plant Physiol* 106:17), genes for glutathione reductase and superoxide dismutase (Aono, et al., (1995) *Plant Cell Physiol* 36:1687) and genes for various phosphotransferases (Datta, et al., (1992) *Plant Mol Biol* 20:619).

(E) A polynucleotide encoding resistance to a herbicide targeting Protoporphyrinogen oxidase (protox) which is necessary for the production of chlorophyll. The protox enzyme serves as the target for a variety of herbicidal compounds. These herbicides also inhibit growth of all the different species of plants present, causing their total destruction. The development of plants containing altered protox activity which are resistant to these herbicides are described in U.S. Pat. Nos. 6,288,306 B1; 6,282,837 B1 and 5,767,373 and International Publication WO 2001/12825.

(F) The aad-1 gene (originally from *Sphingobium herbicidovorans*) encodes the aryloxyalkanoate dioxygenase (AAD-1) protein. The trait confers tolerance to 2,4-dichlorophenoxyacetic acid and aryloxyphenoxypropionate (commonly referred to as "fop" herbicides such as quizalofop) herbicides. The aad-1 gene, itself, for herbicide tolerance in plants was first disclosed in WO 2005/107437 (see also, US 2009/0093366). The aad-12 gene, derived from *Delftia acidovorans*, which encodes the aryloxyalkanoate dioxygenase (AAD-12) protein that confers tolerance to 2,4-dichlorophenoxyacetic acid and pyridyloxyacetate herbicides by deactivating several herbicides with an aryloxyalkanoate moiety, including phenoxy auxin (e.g., 2,4-D, MCPA), as well as pyridyloxy auxins (e.g., fluroxypyr, triclopyr).

(G) A polynucleotide encoding a herbicide resistant dicamba monooxygenase disclosed in US Patent Application Publication 2003/0135879 for imparting dicamba tolerance;

(H) A polynucleotide molecule encoding bromoxynil nitrilase (Bxn) disclosed in U.S. Pat. No. 4,810,648 for imparting bromoxynil tolerance;

(I) A polynucleotide molecule encoding phytoene (crtI) described in Misawa, et al., (1993) *Plant J.* 4:833-840 and in Misawa, et al., (1994) *Plant J.* 6:481-489 for norflurazon tolerance.

3. Transgenes that Confer or Contribute to an Altered Grain Characteristic

Such as:

(A) Altered fatty acids, for example, by (1) Down-regulation of stearoyl-ACP to increase stearic acid content of the plant. See, Knultzon, et al., (1992) *Proc. Natl. Acad. Sci. USA* 89:2624 and WO 1999/64579 (Genes to Alter Lipid Profiles in Corn).

(2) Elevating oleic acid via FAD-2 gene modification and/or decreasing linolenic acid via FAD-3 gene modification (see, U.S. Pat. Nos. 6,063,947; 6,323,392; 6,372,965 and WO 1993/11245).

(3) Altering conjugated linolenic or linoleic acid content, such as in WO 2001/12800.

(4) Altering LEC1, AGP, Dek1, Superal1, mi1 ps, various lpa genes such as lpa1, lpa3, hpt or hggt. For example, see, WO 2002/42424, WO 1998/22604, WO 2003/011015, WO 2002/057439, WO 2003/011015, U.S. Pat. Nos. 6,423,886, 6,197,561, 6,825,397 and US Patent Application Publication Numbers US 2003/0079247, US 2003/0204870 and Rivera-Madrid, et al., (1995) *Proc. Natl. Acad. Sci.* 92:5620-5624.

(5) Genes encoding delta-8 desaturase for making long-chain polyunsaturated fatty acids (U.S. Pat. Nos. 8,058,571 and 8,338,152), delta-9 desaturase for lowering saturated fats (U.S. Pat. No. 8,063,269), Primula Δ6-desaturase for improving omega-3 fatty acid profiles.

(6) Isolated nucleic acids and proteins associated with lipid and sugar metabolism regulation, in particular, lipid metabolism protein (LMP) used in methods of producing transgenic plants and modulating levels of seed storage compounds including lipids, fatty acids, starches or seed storage proteins and use in methods of modulating the seed size, seed number, seed weights, root length and leaf size of plants (EP 2404499).

(7) Altering expression of a High-Level Expression of Sugar-Inducible 2 (HSI2) protein in the plant to increase or decrease expression of HSI2 in the plant. Increasing expression of HSI2 increases oil content while decreasing expression of HSI2 decreases abscisic acid sensitivity and/or increases drought resistance (US Patent Application Publication Number 2012/0066794).

(8) Expression of cytochrome b5 (Cb5) alone or with FAD2 to modulate oil content in plant seed, particularly to increase the levels of omega-3 fatty acids and improve the ratio of omega-6 to omega-3 fatty acids (US Patent Application Publication Number 2011/0191904).

(9) Nucleic acid molecules encoding wrinkled1-like polypeptides for modulating sugar metabolism (U.S. Pat. No. 8,217,223).

(B) Altered phosphorus content, for example, by the (1) Introduction of a phytase-encoding gene would enhance breakdown of phytate, adding more free phosphate to the transformed plant. For example, see, Van Hartingsveldt, et al., (1993) *Gene* 127:87, for a disclosure of the nucleotide sequence of an *Aspergillus niger* phytase gene.

(2) Modulating a gene that reduces phytate content. In maize, this, for example, could be accomplished, by cloning and then re-introducing DNA associated with one or more of the alleles, such as the LPA alleles, identified in maize mutants characterized by low levels of phytic acid, such as in WO 2005/113778 and/or by altering inositol kinase activity as in WO 2002/059324, US Patent Application Publication Number 2003/0009011, WO 2003/027243, US Patent Application Publication Number 2003/0079247, WO 1999/05298, U.S. Pat. No. 6,197,561, U.S. Pat. No. 6,291,224, U.S. Pat. No. 6,391,348, WO 2002/059324, US Patent Application Publication Number 2003/0079247, WO 1998/45448, WO 1999/55882, WO 2001/04147.

(C) Altered carbohydrates affected, for example, by altering a gene for an enzyme that affects the branching pattern of starch or, a gene altering thioredoxin such as NTR and/or TRX (see, U.S. Pat. No. 6,531,648. which is incorporated by reference for this purpose) and/or a gamma zein knock out or mutant such as cs27 or TUSC27 or en27 (see, U.S. Pat. No. 6,858,778 and US Patent Application Publication Number 2005/0160488, US Patent Application Publication Number 2005/0204418, which are incorporated by reference for this purpose). See, Shiroza, et al., (1988) *J. Bacteriol.* 170:810 (nucleotide sequence of *Streptococcus* mutant fructosyltransferase gene), Steinmetz, et al., (1985) *Mol. Gen. Genet.* 200:220 (nucleotide sequence of *Bacillus subtilis* levansucrase gene), Pen, et al., (1992) *Bio/Technology* 10:292 (production of transgenic plants that express *Bacillus licheniformis* alpha-amylase), Elliot, et al., (1993) *Plant Molec. Biol.* 21:515 (nucleotide sequences of tomato invertase genes), Søgaard, et al., (1993) *J. Biol. Chem.* 268:22480 (site-directed mutagenesis of barley alpha-amylase gene) and Fisher, et al., (1993) *Plant Physiol.* 102:1045 (maize endosperm starch branching enzyme II), WO 1999/10498 (improved digestibility and/or starch extraction through modification of UDP-D-xylose 4-epimerase, Fragile 1 and 2, Refl, HCHL, C4H), U.S. Pat. No. 6,232,529 (method of producing high oil seed by modification of starch levels (AGP)). The fatty acid modification genes mentioned herein may also be used to affect starch content and/or composition through the interrelationship of the starch and oil pathways.

(D) Altered antioxidant content or composition, such as alteration of tocopherol or tocotrienols. For example, see, U.S. Pat. No. 6,787,683, US Patent Application Publication Number 2004/0034886 and WO 2000/68393 involving the manipulation of antioxidant levels and WO 2003/082899 through alteration of a homogentisate geranyl geranyl transferase (hggt).

(E) Altered essential seed amino acids. For example, see, U.S. Pat. No. 6,127,600 (method of increasing accumulation of essential amino acids in seeds), U.S. Pat. No. 6,080,913 (binary methods of increasing accumulation of essential amino acids in seeds), U.S. Pat. No. 5,990,389 (high lysine), WO 1999/40209 (alteration of amino acid compositions in seeds), WO 1999/29882 (methods for altering amino acid content of proteins), U.S. Pat. No. 5,850,016 (alteration of amino acid compositions in seeds), WO 1998/20133 (proteins with enhanced levels of essential amino acids), U.S. Pat. No. 5,885,802 (high methionine), U.S. Pat. No. 5,885,801 (high threonine), U.S. Pat. No. 6,664,445 (plant amino acid biosynthetic enzymes), U.S. Pat. No. 6,459,019 (increased lysine and threonine), U.S. Pat. No. 6,441,274 (plant tryptophan synthase beta subunit), U.S. Pat. No. 6,346,403 (methionine metabolic enzymes), U.S. Pat. No. 5,939,599 (high sulfur), U.S. Pat. No. 5,912,414 (increased methionine), WO 1998/56935 (plant amino acid biosynthetic enzymes), WO 1998/45458 (engineered seed protein having higher percentage of essential amino acids), WO 1998/42831 (increased lysine), U.S. Pat. No. 5,633,436 (increasing sulfur amino acid content), U.S. Pat. No. 5,559,223 (synthetic storage proteins with defined structure containing programmable levels of essential amino acids for improvement of the nutritional value of plants), WO 1996/01905 (increased threonine), WO 1995/15392 (increased lysine), US Patent Application Publication Number 2003/0163838, US Patent Application Publication Number 2003/0150014, US Patent Application Publication Number 2004/0068767, U.S. Pat. No. 6,803,498, WO 2001/79516.

4. Genes that Control Male-Sterility:

There are several methods of conferring genetic male sterility available, such as multiple mutant genes at separate locations within the genome that confer male sterility, as disclosed in U.S. Pat. Nos. 4,654,465 and 4,727,219 to Brar, et al., and chromosomal translocations as described by Patterson in U.S. Pat. Nos. 3,861,709 and 3,710,511. In addition to these methods, Albertsen, et al., U.S. Pat. No. 5,432,068, describe a system of nuclear male sterility which includes: identifying a gene which is critical to male fertility; silencing this native gene which is critical to male fertility; removing the native promoter from the essential male fertility gene and replacing it with an inducible promoter; inserting this genetically engineered gene back into the plant; and thus creating a plant that is male sterile because the inducible promoter is not "on" resulting in the male fertility gene not being transcribed. Fertility is restored by inducing or turning "on", the promoter, which in turn allows the gene that confers male fertility to be transcribed.

(A) Introduction of a deacetylase gene under the control of a tapetum-specific promoter and with the application of the chemical N—Ac-PPT (WO 2001/29237).

(B) Introduction of various stamen-specific promoters (WO 1992/13956, WO 1992/13957).

(C) Introduction of the barnase and the barstar gene (Paul, et al., (1992) *Plant Mol. Biol.* 19:611-622).

For additional examples of nuclear male and female sterility systems and genes, see also, U.S. Pat. Nos. 5,859,341; 6,297,426; 5,478,369; 5,824,524; 5,850,014 and 6,265,640, all of which are hereby incorporated by reference.

5. Genes that Create a Site for Site Specific DNA Integration.

This includes the introduction of FRT sites that may be used in the FLP/FRT system and/or Lox sites that may be used in the Cre/Loxp system. For example, see, Lyznik, et al., (2003) *Plant Cell Rep* 21:925-932 and WO 1999/25821, which are hereby incorporated by reference. Other systems that may be used include the Gin recombinase of phage Mu (Maeser, et al., (1991) Vicki Chandler, The Maize Handbook ch. 118 (Springer-Verlag 1994), the Pin recombinase of *E. coli* (Enomoto, et al., 1983) and the R/RS system of the pSRi plasmid (Araki, et al., 1992).

6. Genes that Affect Abiotic Stress Resistance

Including but not limited to flowering, ear and seed development, enhancement of nitrogen utilization efficiency, altered nitrogen responsiveness, drought resistance or tolerance, cold resistance or tolerance and salt resistance or tolerance and increased yield under stress.

(A) For example, see: WO 2000/73475 where water use efficiency is altered through alteration of malate; U.S. Pat. Nos. 5,892,009, 5,965,705, 5,929,305, 5,891,859, 6,417,428, 6,664,446, 6,706,866, 6,717,034, 6,801,104, WO 2000/060089, WO 2001/026459, WO 2001/035725, WO 2001/034726, WO 2001/035727, WO 2001/036444, WO 2001/036597, WO 2001/036598, WO 2002/015675, WO 2002/017430, WO 2002/077185, WO 2002/079403, WO 2003/013227, WO 2003/013228, WO 2003/014327, WO 2004/031349, WO 2004/076638, WO 199809521.

(B) WO 199938977 describing genes, including CBF genes and transcription factors effective in mitigating the negative effects of freezing, high salinity and drought on plants, as well as conferring other positive effects on plant phenotype.

(C) US Patent Application Publication Number 2004/0148654 and WO 2001/36596 where abscisic acid is altered in plants resulting in improved plant phenotype such as increased yield and/or increased tolerance to abiotic stress.

(D) WO 2000/006341, WO 2004/090143, U.S. Pat. Nos. 7,531,723 and 6,992,237 where cytokinin expression is modified resulting in plants with increased stress tolerance, such as drought tolerance, and/or increased yield. Also see, WO 2002/02776, WO 2003/052063, JP 2002/281975, U.S. Pat. No. 6,084,153, WO 2001/64898, U.S. Pat. No. 6,177,275 and U.S. Pat. No. 6,107,547 (enhancement of nitrogen utilization and altered nitrogen responsiveness).

(E) For ethylene alteration, see, US Patent Application Publication Number 2004/0128719, US Patent Application Publication Number 2003/0166197 and WO 2000/32761.

(F) For plant transcription factors or transcriptional regulators of abiotic stress, see, e.g., US Patent Application Publication Number 2004/0098764 or US Patent Application Publication Number 2004/0078852.

(G) Genes that increase expression of vacuolar pyrophosphatase such as AVP1 (U.S. Pat. No. 8,058,515) for increased yield; nucleic acid encoding a HSFA4 or a HSFA5 (Heat Shock Factor of the class A4 or A5) polypeptides, an oligopeptide transporter protein (OPT4-like) polypeptide; a plastochron2-like (PLA2-like) polypeptide or a Wuschel related homeobox 1-like (WOX1-like) polypeptide (U. Patent Application Publication Number US 2011/0283420).

(H) Down regulation of polynucleotides encoding poly (ADP-ribose) polymerase (PARP) proteins to modulate programmed cell death (U.S. Pat. No. 8,058,510) for increased vigor.

(I) Polynucleotide encoding DTP21 polypeptides for conferring drought resistance (US Patent Application Publication Number US 2011/0277181).

(J) Nucleotide sequences encoding ACC Synthase 3 (ACS3) proteins for modulating development, modulating response to stress, and modulating stress tolerance (US Patent Application Publication Number US 2010/0287669).

(K) Polynucleotides that encode proteins that confer a drought tolerance phenotype (DTP) for conferring drought resistance (WO 2012/058528).

(L) Tocopherol cyclase (TC) genes for conferring drought and salt tolerance (US Patent Application Publication Number 2012/0272352).

(M) CAAX amino terminal family proteins for stress tolerance (U.S. Pat. No. 8,338,661).

(N) Mutations in the SAL1 encoding gene have increased stress tolerance, including increased drought resistant (US Patent Application Publication Number 2010/0257633).

(O) Expression of a nucleic acid sequence encoding a polypeptide selected from the group consisting of: GRF polypeptide, RAA1-like polypeptide, SYR polypeptide, ARKL polypeptide, and YTP polypeptide increasing yield-related traits (US Patent Application Publication Number 2011/0061133).

(P) Modulating expression in a plant of a nucleic acid encoding a Class III Trehalose Phosphate Phosphatase (TPP) polypeptide for enhancing yield-related traits in plants, particularly increasing seed yield (US Patent Application Publication Number 2010/0024067).

Other genes and transcription factors that affect plant growth and agronomic traits such as yield, flowering, plant growth and/or plant structure, can be introduced or introgressed into plants, see e.g., WO 1997/49811 (LHY), WO 1998/56918 (ESD4), WO 1997/10339 and U.S. Pat. No. 6,573,430 (TFL), U.S. Pat. No. 6,713,663 (FT), WO 1996/14414 (CON), WO 1996/38560, WO 2001/21822 (VRN1), WO 2000/44918 (VRN2), WO 1999/49064 (GI), WO 2000/46358 (FR1), WO 1997/29123, U.S. Pat. No. 6,794,560, U.S. Pat. No. 6,307,126 (GAI), WO 1999/09174 (D8 and Rht) and WO 2004/076638 and WO 2004/031349 (transcription factors).

7. Genes that Confer Increased Yield (A) A transgenic crop plant transformed by a 1-AminoCyclopropane-1-Carboxylate Deaminase-like Polypeptide (ACCDP) coding nucleic acid, wherein expression of the nucleic acid sequence in the crop plant results in the plant's increased root growth, and/or increased yield, and/or increased tolerance to environmental stress as compared to a wild type variety of the plant (U.S. Pat. No. 8,097,769).

(B) Over-expression of maize zinc finger protein gene (Zm-ZFP1) using a seed preferred promoter has been shown to enhance plant growth, increase kernel number and total kernel weight per plant (US Patent Application Publication Number 2012/0079623).

(C) Constitutive over-expression of maize lateral organ boundaries (LOB) domain protein (Zm-LOBDP1) has been shown to increase kernel number and total kernel weight per plant (US Patent Application Publication Number 2012/0079622).

(D) Enhancing yield-related traits in plants by modulating expression in a plant of a nucleic acid encoding a VIM1 (Variant in Methylation 1)-like polypeptide or a VTC2-like (GDP-L-galactose phosphorylase) polypeptide or a DUF1685 polypeptide or an ARF6-like (Auxin Responsive Factor) polypeptide (WO 2012/038893).

(E) Modulating expression in a plant of a nucleic acid encoding a Ste20-like polypeptide or a homologue thereof gives plants having increased yield relative to control plants (EP 2431472).

(F) Genes encoding nucleoside diphosphatase kinase (NDK) polypeptides and homologs thereof for modifying the plant's root architecture (US Patent Application Publication Number 2009/0064373).

8. Genes that Confer Plant Digestibility.

(A) Altering the level of xylan present in the cell wall of a plant by modulating expression of xylan synthase (U.S. Pat. No. 8,173,866).

In some embodiment the stacked trait may be a trait or event that has received regulatory approval including but not limited to the events in Table 5A-5F.

TABLE 5A

*Medicago sativa* Alfalfa

| Event | Company | Description |
| --- | --- | --- |
| J101, J163 | Monsanto Company and Forage Genetics International | Glyphosate herbicide tolerant alfalfa (lucerne) produced by inserting a gene encoding the enzyme 5-enolypyruvylshikimate-3-phosphate synthase (EPSPS) from the CP4 strain of *Agrobacterium tumefaciens*. |

TABLE 5B

*Helianthus annuus* Sunflower

| Event | Company | Description |
| --- | --- | --- |
| X81359 | BASF Inc. | Tolerance to imidazolinone herbicides by selection of a naturally occurring mutant. |

TABLE 5C

Oryza sativa Rice

| Event | Company | Description |
|---|---|---|
| CL121, CL141, CFX51 | BASF Inc. | Tolerance to the imidazolinone herbicide, imazethapyr, induced by chemical mutagenesis of the acetolactate synthase (ALS) enzyme using ethyl methanesulfonate (EMS). |
| IMINTA-1, IMINTA-4 | BASF Inc. | Tolerance to imidazolinone herbicides induced by chemical mutagenesis of the acetolactate synthase (ALS) enzyme using sodium azide. |
| LLRICE06, LLRICE62 | Aventis CropScience | Glufosinate ammonium herbicide tolerant rice produced by inserting a modified phosphinothricin acetyltransferase (PAT) encoding gene from the soil bacterium *Streptomyces hygroscopicus*). |
| LLRICE601 | Bayer CropScience (Aventis CropScience (AgrEvo)) | Glufosinate ammonium herbicide tolerant rice produced by inserting a modified phosphinothricin acetyltransferase (PAT) encoding gene from the soil bacterium *Streptomyces hygroscopicus*). |
| PWC16 | BASF Inc. | Tolerance to the imidazolinone herbicide, imazethapyr, induced by chemical mutagenesis of the acetolactate synthase (ALS) enzyme using ethyl methanesulfonate (EMS). |

TABLE 5C

Triticum aestivum Wheat

| Event | Company | Description |
|---|---|---|
| AP205CL | BASF Inc. | Selection for a mutagenized version of the enzyme acetohydroxyacid synthase (AHAS), also known as acetolactate synthase (ALS) or acetolactate pyruvate- lyase. |
| AP602CL | BASF Inc. | Selection for a mutagenized version of the enzyme acetohydroxyacid synthase (AHAS), also known as acetolactate synthase (ALS) or acetolactate pyruvate- lyase. |
| BW255-2, BW238-3 | BASF Inc. | Selection for a mutagenized version of the enzyme acetohydroxyacid synthase (AHAS), also known as acetolactate synthase (ALS) or acetolactate pyruvate- lyase. |
| BW7 | BASF Inc. | Tolerance to imidazolinone herbicides induced by chemical mutagenesis of the acetohydroxyacid synthase (AHAS) gene using sodium azide. |
| MON71800 | Monsanto Company | Glyphosate tolerant wheat variety produced by inserting a modified 5-enolpyruvylshikimate-3-phosphate synthase (EPSPS) encoding gene from the soil bacterium *Agrobacterium tumefaciens*, strain CP4. |
| SWP965001 | Cyanamid Crop Protection | Selection for a mutagenized version of the enzyme acetohydroxyacid synthase (AHAS), also known as acetolactate synthase (ALS) or acetolactate pyruvate- lyase. |
| Teal 11A | BASF Inc. | Selection for a mutagenized version of the enzyme acetohydroxyacid synthase (AHAS), also known as acetolactate synthase (ALS) or acetolactate pyruvate- lyase. |

TABLE 5E

Glycine max L. Soybean

| Event | Company | Description |
|---|---|---|
| A2704-12, A2704-21, A5547-35 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces viridochromogenes*. |
| A5547-127 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces viridochromogenes*. |
| BPS-CV127-9 | BASF Inc. | The introduced csr1-2 gene from *Arabidopsis thaliana* encodes an acetohydroxyacid synthase protein that confers tolerance to imidazolinone herbicides due to a point mutation that results in a single amino acid substitution in which the serine residue at position 653 is replaced by asparagine (S653N). |
| DP-305423 | Pioneer Hi-Bred International Inc. | High oleic acid soybean produced by inserting additional copies of a portion of the omega-6 desaturase encoding gene, gm-fad2-1 resulting in silencing of the endogenous omega-6 desaturase gene (FAD2-1). |
| DP356043 | Pioneer Hi-Bred International Inc. | Soybean event with two herbicide tolerance genes: glyphosate N-acetlytransferase, which detoxifies glyphosate, and a modified acetolactate synthase (ALS) gene which is tolerant to ALS-inhibiting herbicides. |
| G94-1, G94-19, G168 | DuPont Canada Agricultural Products | High oleic acid soybean produced by inserting a second copy of the fatty acid desaturase (GmFad2-1) encoding gene from soybean, which resulted in "silencing" of the endogenous host gene. |
| GTS 40-3-2 | Monsanto Company | Glyphosate tolerant soybean variety produced by inserting a modified 5-enolpyruvylshikimate-3-phosphate synthase (EPSPS) encoding gene from the soil bacterium *Agrobacterium tumefaciens*. |

TABLE 5E-continued

| | Glycine max L. Soybean | |
|---|---|---|
| Event | Company | Description |
| GU262 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium Streptomyces viridochromogenes. |
| MON87701 | Monsanto Company | Resistance to Lepidopteran pests of soybean including velvetbean caterpillar (Anticarsia gemmatalis) and soybean looper (Pseudoplusia includens). |
| MON87701 × MON89788 | Monsanto Company | Glyphosate herbicide tolerance through expression of the EPSPS encoding gene from A. tumefaciens strain CP4, and resistance to Lepidopteran pests of soybean including velvetbean caterpillar (Anticarsia gemmatalis) and soybean looper (Pseudoplusia includens) via expression of the Cry1Ac encoding gene from B. thuringiensis. |
| MON89788 | Monsanto Company | Glyphosate-tolerant soybean produced by inserting a modified 5-enolpyruvylshikimate-3-phosphate synthase (EPSPS) encoding aroA (epsps) gene from Agrobacterium tumefaciens CP4. |
| OT96-15 | Agriculture & Agri-Food Canada | Low linolenic acid soybean produced through traditional cross-breeding to incorporate the novel trait from a naturally occurring fan1 gene mutant that was selected for low linolenic acid. |
| W62, W98 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium Streptomyces hygroscopicus. |

TABLE 5F

| | Zea mays L. Maize | |
|---|---|---|
| Event | Company | Description |
| 176 | Syngenta Seeds, Inc. | Insect-resistant maize produced by inserting the Cry1Ab gene from Bacillus thuringiensis subsp. kurstaki. The genetic modification affords resistance to attack by the European corn borer (ECB). |
| 3751IR | Pioneer Hi-Bred International Inc. | Selection of somaclonal variants by culture of embryos on imidazolinone containing media. |
| 676, 678, 680 | Pioneer Hi-Bred International Inc. | Male-sterile and glufosinate ammonium herbicide tolerant maize produced by inserting genes encoding DNA adenine methylase and phosphinothricin acetyltransferase (PAT) from Escherichia coli and Streptomyces viridochromogenes, respectively. |
| B16 (DLL25) | Dekalb Genetics Corporation | Glufosinate ammonium herbicide tolerant maize produced by inserting the gene encoding phosphinothricin acetyltransferase (PAT) from Streptomyces hygroscopicus. |
| BT11 (X4334CBR, X4734CBR) | Syngenta Seeds, Inc. | Insect-resistant and herbicide tolerant maize produced by inserting the Cry1Ab gene from Bacillus thuringiensis subsp. kurstaki, and the phosphinothricin N-acetyltransferase (PAT) encoding gene from S. viridochromogenes. |
| BT11 × GA21 | Syngenta Seeds, Inc. | Stacked insect resistant and herbicide tolerant maize produced by conventional cross breeding of parental lines BT11 (OECD unique identifier: SYN-BTO11-1) and GA21 (OECD unique identifier: MON-OOO21-9). |
| BT11 × MIR162 × MIR604 × GA21 | Syngenta Seeds, Inc. | Resistance to Coleopteran pests, particularly corn rootworm pests (Diabrotica spp.) and several Lepidopteran pests of corn, including European corn borer (ECB, Ostrinia nubilalis), corn earworm (CEW, Helicoverpa zea), fall army worm (FAW, Spodoptera frugiperda), and black cutworm (BCW, Agrotis ipsilon); tolerance to glyphosate and glufosinate-ammonium containing herbicides. |
| BT11 × MIR162 | Syngenta Seeds, Inc. | Stacked insect resistant and herbicide tolerant maize produced by conventional cross breeding of parental lines BT11 (OECD unique identifier: SYN-BTO11-1) and MIR162 (OECD unique identifier: |

TABLE 5F-continued

Zea mays L. Maize

| Event | Company | Description |
|---|---|---|
| BT11 × MIR162 × MIR604 | Syngenta Seeds, Inc. | SYN-IR162-4). Resistance to the European Corn Borer and tolerance to the herbicide glufosinate ammonium (Liberty) is derived from BT11, which contains the Cry1Ab gene from *Bacillus thuringiensis* subsp. *kurstaki*, and the phosphinothricin N-acetyltransferase (PAT) encoding gene from *S. viridochromogenes*. Resistance to other Lepidopteran pests, including *H. zea*, *S. frugiperda*, *A. ipsilon*, and *S. albicosta*, is derived from MIR162, which contains the vip3Aa gene from *Bacillus thuringiensis* strain AB88. *Bacillus thuringiensis* Cry1Ab delta-endotoxin protein and the genetic material necessary for its production (via elements of vector pZO1502) in Event Bt11 corn (OECD Unique Identifier: SYN-BTO11-1) × *Bacillus thuringiensis* Vip3Aa20 insecticidal protein and the genetic material necessary for its production (via elements of vector pNOV1300) in Event MIR162 maize (OECD Unique Identifier: SYN-IR162-4) × modified Cry3A protein and the genetic material necessary for its production (via elements of vector pZM26) in Event MIR604 corn (OECD Unique Identifier: SYN-IR6O4-5). |
| CBH-351 | Aventis CropScience | Insect-resistant and glufosinate ammonium herbicide tolerant maize developed by inserting genes encoding Cry9C protein from *Bacillus thuringiensis* subsp *tolworthi* and phosphinothricin acetyltransferase (PAT) from *Streptomyces hygroscopicus*. |
| DAS-06275-8 | DOW AgroSciences LLC | Lepidopteran insect resistant and glufosinate ammonium herbicide-tolerant maize variety produced by inserting the Cry1F gene from *Bacillus thuringiensis* var *aizawai* and the phosphinothricin acetyltransferase (PAT) from *Streptomyces hygroscopicus*. |
| BT11 × MIR604 | Syngenta Seeds, Inc. | Stacked insect resistant and herbicide tolerant maize produced by conventional cross breeding of parental lines BT11 (OECD unique identifier: SYN-BTO11-1) and MIR604 (OECD unique identifier: SYN-IR6O5-5). Resistance to the European Corn Borer and tolerance to the herbicide glufosinate ammonium (Liberty) is derived from BT11, which contains the Cry1Ab gene from *Bacillus thuringiensis* subsp. *kurstaki*, and the phosphinothricin N-acetyltransferase (PAT) encoding gene from *S. viridochromogenes*. Corn rootworm-resistance is derived from MIR604 which contains the mCry3A gene from *Bacillus thuringiensis*. |
| BT11 × MIR604 × GA21 | Syngenta Seeds, Inc. | Stacked insect resistant and herbicide tolerant maize produced by conventional cross breeding of parental lines BT11 (OECD unique identifier: SYN-BTO11-1), MIR604 (OECD unique identifier: SYN-IR6O5-5) and GA21 (OECD unique identifier: MON-OOO21-9). Resistance to the European Corn Borer and tolerance to the herbicide glufosinate ammonium (Liberty) is derived from BT11, which contains the Cry1Ab gene from *Bacillus thuringiensis* subsp. *kurstaki*, and the phosphinothricin N-acetyltransferase (PAT) encoding gene from *S. viridochromogenes*. Corn rootworm-resistance is derived from MIR604 which contains the mCry3A gene from *Bacillus thuringiensis*. Tolerance to glyphosate herbicide is derived from GA21 which contains a a modified EPSPS gene from maize. |
| DAS-59122-7 | DOW AgroSciences LLC and Pioneer Hi-Bred International Inc. | Corn rootworm-resistant maize produced by inserting the Cry34Ab1 and Cry35Ab1 genes from *Bacillus thuringiensis* strain PS149B1. The PAT encoding gene from *Streptomyces viridochromogenes* was introduced as a selectable marker. |
| DAS-59122-7 × TC1507 × NK603 | DOW AgroSciences LLC and Pioneer Hi-Bred International Inc. | Stacked insect resistant and herbicide tolerant maize produced by conventional cross breeding of parental lines DAS-59122-7 (OECD unique |

TABLE 5F-continued

| Zea mays L. Maize | | |
|---|---|---|
| Event | Company | Description |
| | | identifier: DAS-59122-7) and TC1507 (OECD unique identifier: DAS-O15O7-1) with NK603 (OECD unique identifier: MON-OO6O3-6). Corn rootworm-resistance is derived from DAS-59122-7 which contains the Cry34Ab1 and Cry35Ab1 genes from *Bacillus thuringiensis* strain PS149B1. Lepidopteran resistance and tolerance to glufosinate ammonium herbicide is derived from TC1507. Tolerance to glyphosate herbicide is derived from NK603. |
| DBT418 | Dekalb Genetics Corporation | Insect-resistant and glufosinate ammonium herbicide tolerant maize developed by inserting genes encoding Cry1AC protein from *Bacillus thuringiensis* subsp *kurstaki* and phosphinothricin acetyltransferase (PAT) from *Streptomyces hygroscopicus* |
| MIR604 × GA21 | Syngenta Seeds, Inc. | Stacked insect resistant and herbicide tolerant maize produced by conventional cross breeding of parental lines MIR604 (OECD unique identifier: SYN-IR6O5-5) and GA21 (OECD unique identifier: MON-OOO21-9). Corn rootworm-resistance is derived from MIR604 which contains the mCry3A gene from *Bacillus thuringiensis*. Tolerance to glyphosate herbicide is derived from GA21. |
| MON80100 | Monsanto Company | Insect-resistant maize produced by inserting the Cry1Ab gene from *Bacillus thuringiensis* subsp. *kurstaki*. The genetic modification affords resistance to attack by the European corn borer (ECB). |
| MON802 | Monsanto Company | Insect-resistant and glyphosate herbicide tolerant maize produced by inserting the genes encoding the Cry1Ab protein from *Bacillus thuringiensis* and the 5-enolpyruvylshikimate-3-phosphate synthase (EPSPS) from *A. tumefaciens* strain CP4. |
| MON809 | Pioneer Hi-Bred International Inc. | Resistance to European corn borer (*Ostrinia nubilalis*) by introduction of a synthetic Cry1Ab gene. Glyphosate resistance via introduction of the bacterial version of a plant enzyme, 5-enolpyruvyl shikimate-3-phosphate synthase (EPSPS). |
| MON810 | Monsanto Company | Insect-resistant maize produced by inserting a truncated form of the Cry1Ab gene from *Bacillus thuringiensis* subsp. *kurstaki* HD-1. The genetic modification affords resistance to attack by the European corn borer (ECB). |
| MON810 × LY038 | Monsanto Company | Stacked insect resistant and enhanced lysine content maize derived from conventional cross-breeding of the parental lines MON810 (OECD identifier: MON-OO81O-6) and LY038 (OECD identifier: REN-OOO38-3). |
| MON810 × MON88017 | Monsanto Company | Stacked insect resistant and glyphosate tolerant maize derived from conventional cross-breeding of the parental lines MON810 (OECD identifier: MON-OO81O-6) and MON88017 (OECD identifier: MON-88O17-3). European corn borer (ECB) resistance is derived from a truncated form of the Cry1Ab gene from *Bacillus thuringiensis* subsp. *kurstaki* HD-1 present in MON810. Corn rootworm resistance is derived from the Cry3Bb1 gene from *Bacillus thuringiensis* subspecies *kumamotoensis* strain EG4691 present in MON88017. Glyphosate tolerance is derived from a 5-enolpyruvylshikimate-3-phosphate synthase (EPSPS) encoding gene from *Agrobacterium tumefaciens* strain CP4 present in MON88017. |
| MON832 | Monsanto Company | Introduction, by particle bombardment, of glyphosate oxidase (GOX) and a modified 5-enolpyruvyl shikimate-3-phosphate synthase (EPSPS), an enzyme involved in the shikimate biochemical pathway for the production of the aromatic amino acids. |
| MON863 | Monsanto Company | Corn rootworm resistant maize produced by inserting the Cry3Bb1 gene from *Bacillus thuringiensis* subsp. *kumamotoensis*. |

TABLE 5F-continued

*Zea mays* L. Maize

| Event | Company | Description |
|---|---|---|
| MON863 × MON810 | Monsanto Company | Stacked insect resistant corn hybrid derived from conventional cross-breeding of the parental lines MON863 (OECD identifier: MON-OO863-5) and MON810 (OECD identifier: MON-OO81O-6) |
| MON863 × MON810 × NK603 | Monsanto Company | Stacked insect resistant and herbicide tolerant corn hybrid derived from conventional cross-breeding of the stacked hybrid MON-OO863-5 × MON-OO81O-6 and NK603 (OECD identifier: MON-OO6O3-6). |
| MON863 × NK603 | Monsanto Company | Stacked insect resistant and herbicide tolerant corn hybrid derived from conventional cross-breeding of the parental lines MON863 (OECD identifier: MON-OO863-5) and NK603 (OECD identifier: MON-OO6O3-6). |
| MON87460 | Monsanto Company | MON 87460 was developed to provide reduced yield loss under water-limited conditions compared to conventional maize. Efficacy in MON 87460 is derived by expression of the inserted *Bacillus subtilis* cold shock protein B (CspB). |
| MON88017 | Monsanto Company | Corn rootworm-resistant maize produced by inserting the Cry3Bb1 gene from *Bacillus thuringiensis* subspecies *kumamotoensis* strain EG4691. Glyphosate tolerance derived by inserting a 5-enolpyruvylshikimate-3-phosphate synthase (EPSPS) encoding gene from *Agrobacterium tumefaciens* strain CP4. |
| MON89034 | Monsanto Company | Maize event expressing two different insecticidal proteins from *Bacillus thuringiensis* providing resistance to number of Lepidopteran pests. |
| MON89034 × MON88017 | Monsanto Company | Stacked insect resistant and glyphosate tolerant maize derived from conventional cross-breeding of the parental lines MON89034 (OECD identifier: MON-89O34-3) and MON88017 (OECD identifier: MON-88O17-3). Resistance to Lepidopteran insects is derived from two Cry genes present in MON89043. Corn rootworm resistance is derived from a single Cry genes and glyphosate tolerance is derived from the 5-enolpyruvylshikimate-3-phosphate synthase (EPSPS) encoding gene from *Agrobacterium tumefaciens* present in MON88017. |
| MON89034 × NK603 | Monsanto Company | Stacked insect resistant and herbicide tolerant maize produced by conventional cross breeding of parental lines MON89034 (OECD identifier: MON-89O34-3) with NK603 (OECD unique identifier: MON-OO6O3-6). Resistance to Lepidopteran insects is derived from two Cry genes present in MON89043. Tolerance to glyphosate herbicide is derived from NK603. |
| NK603 × MON810 | Monsanto Company | Stacked insect resistant and herbicide tolerant corn hybrid derived from conventional cross-breeding of the parental lines NK603 (OECD identifier: MON-OO6O3-6) and MON810 (OECD identifier: MON-OO81O-6). |
| MON89034 × TC1507 × MON88017 × DAS-59122-7 | Monsanto Company and Mycogen Seeds c/o Dow AgroSciences LLC | Stacked insect resistant and herbicide tolerant maize produced by conventional cross breeding of parental lines: MON89034, TC1507, MON88017, and DAS-59122. Resistance to the above-ground and below-ground insect pests and tolerance to glyphosate and glufosinate-ammonium containing herbicides. |
| MS3 | Bayer CropScience (Aventis CropScience (AgrEvo)) | Male sterility caused by expression of the barnase ribonuclease gene from *Bacillus amyloliquefaciens*; PPT resistance was via PPT-acetyltransferase (PAT). |
| MS6 | Bayer CropScience (Aventis CropScience (AgrEvo)) | Male sterility caused by expression of the barnase ribonuclease gene from *Bacillus amyloliquefaciens*; PPT resistance was via PPT-acetyltransferase (PAT). |
| NK603 | Monsanto Company | Introduction, by particle bombardment, of a modified 5-enolpyruvyl shikimate-3-phosphate synthase (EPSPS), an enzyme involved in the shikimate biochemical pathway for the production of the aromatic amino acids. |
| NK603 × T25 | Monsanto Company | Stacked glufosinate ammonium and glyphosate herbicide tolerant maize hybrid derived from conventional cross-breeding of the parental lines NK603 (OECD identifier: MON-OO6O3-6) and T25 (OECD identifier: ACS-ZM003-2). |

TABLE 5F-continued

Zea mays L. Maize

| Event | Company | Description |
| --- | --- | --- |
| T25 × MON810 | Bayer CropScience (Aventis CropScience (AgrEvo)) | Stacked insect resistant and herbicide tolerant corn hybrid derived from conventional cross-breeding of the parental lines T25 (OECD identifier: ACS-ZMOO3-2) and MON810 (OECD identifier: MON-OO81O-6). |
| TC1507 | Mycogen (c/o Dow AgroSciences); Pioneer (c/o DuPont) | Insect-resistant and glufosinate ammonium herbicide tolerant maize produced by inserting the Cry1F gene from Bacillus thuringiensis var. aizawai and the phosphinothricin N-acetyltransferase encoding gene from Streptomyces viridochromogenes. |
| TC1507 × NK603 | DOW AgroSciences LLC | Stacked insect resistant and herbicide tolerant corn hybrid derived from conventional cross-breeding of the parental lines 1507 (OECD identifier: DAS-O15O7-1) and NK603 (OECD identifier: MON-OO6O3-6). |
| TC1507 × DAS-59122-7 | DOW AgroSciences LLC and Pioneer Hi-Bred International Inc. | Stacked insect resistant and herbicide tolerant maize produced by conventional cross breeding of parental lines TC1507 (OECD unique identifier: DAS-O15O7-1) with DAS-59122-7 (OECD unique identifier: DAS-59122-7). Resistance to Lepidopteran insects is derived from TC1507 due the presence of the Cry1F gene from Bacillus thuringiensis var. aizawai. Corn rootworm-resistance is derived from DAS-59122-7 which contains the Cry34Ab1 and Cry35Ab1 genes from Bacillus thuringiensis strain PS149B1. Tolerance to glufosinate ammonium herbicide is derived from TC1507 from the phosphinothricin N-acetyltransferase encoding gene from Streptomyces viridochromogenes. |

Other events with regulatory approval are well known to one skilled in the art and can be found at the Center for Environmental Risk Assessment (cera-gmc.org/?action=gm_crop_database, which can be accessed using the www prefix) and at the International Service for the Acquisition of Agri-Biotech Applications (isaaa.org/gmapprovaldatabase/default.asp, which can be accessed using the www prefix).

Gene Silencing

In some embodiments the stacked trait may be in the form of silencing of one or more polynucleotides of interest resulting in suppression of one or more target pest polypeptides. In some embodiments the silencing is achieved through the use of a suppression DNA construct.

In some embodiments one or more polynucleotide encoding the polypeptides of the PtIP-83 polypeptide or fragments or variants thereof may be stacked with one or more polynucleotides encoding one or more polypeptides having insecticidal activity or agronomic traits as set forth supra and optionally may further include one or more polynucleotides providing for gene silencing of one or more target polynucleotides as discussed infra. "Suppression DNA construct" is a recombinant DNA construct which when transformed or stably integrated into the genome of the plant, results in "silencing" of a target gene in the plant. The target gene may be endogenous or transgenic to the plant. "Silencing," as used herein with respect to the target gene, refers generally to the suppression of levels of mRNA or protein/enzyme expressed by the target gene, and/or the level of the enzyme activity or protein functionality. The term "suppression" includes lower, reduce, decline, decrease, inhibit, eliminate and prevent. "Silencing" or "gene silencing" does not specify mechanism and is inclusive, and not limited to, anti-sense, cosuppression, viral-suppression, hairpin suppression, stem-loop suppression, RNAi-based approaches and small RNA-based approaches.

A suppression DNA construct may comprise a region derived from a target gene of interest and may comprise all or part of the nucleic acid sequence of the sense strand (or antisense strand) of the target gene of interest. Depending upon the approach to be utilized, the region may be 100% identical or less than 100% identical (e.g., at least 50% or any integer between 51% and 100% identical) to all or part of the sense strand (or antisense strand) of the gene of interest.

Suppression DNA constructs are well-known in the art, are readily constructed once the target gene of interest is selected, and include, without limitation, cosuppression constructs, antisense constructs, viral-suppression constructs, hairpin suppression constructs, stem-loop suppression constructs, double-stranded RNA-producing constructs, and more generally, RNAi (RNA interference) constructs and small RNA constructs such as siRNA (short interfering RNA) constructs and miRNA (microRNA) constructs.

"Antisense inhibition" refers to the production of antisense RNA transcripts capable of suppressing the expression of the target protein.

"Antisense RNA" refers to an RNA transcript that is complementary to all or part of a target primary transcript or mRNA and that blocks the expression of a target isolated nucleic acid fragment (U.S. Pat. No. 5,107,065). The complementarity of an antisense RNA may be with any part of the specific gene transcript, i.e., at the 5' non-coding sequence, 3' non-coding sequence, introns or the coding sequence.

"Cosuppression" refers to the production of sense RNA transcripts capable of suppressing the expression of the target protein. "Sense" RNA refers to RNA transcript that includes the mRNA and can be translated into protein within a cell or in vitro. Cosuppression constructs in plants have been previously designed by focusing on overexpression of a nucleic acid sequence having homology to a native mRNA, in the sense orientation, which results in the reduction of all RNA having homology to the overexpressed sequence (see, Vaucheret, et al., (1998) Plant J. 16:651-659 and Gura, (2000) Nature 404:804-808).

Another variation describes the use of plant viral sequences to direct the suppression of proximal mRNA encoding sequences (PCT Publication WO 1998/36083).

Recent work has described the use of "hairpin" structures that incorporate all or part, of an mRNA encoding sequence in a complementary orientation that results in a potential "stem-loop" structure for the expressed RNA (PCT Publication WO 1999/53050). In this case the stem is formed by polynucleotides corresponding to the gene of interest inserted in either sense or anti-sense orientation with respect to the promoter and the loop is formed by some polynucleotides of the gene of interest, which do not have a complement in the construct. This increases the frequency of cosuppression or silencing in the recovered transgenic plants. For review of hairpin suppression, see, Wesley, et al., (2003) Methods in Molecular Biology, Plant Functional Genomics: Methods and Protocols 236:273-286.

A construct where the stem is formed by at least 30 nucleotides from a gene to be suppressed and the loop is formed by a random nucleotide sequence has also effectively been used for suppression (PCT Publication WO 1999/61632).

The use of poly-T and poly-A sequences to generate the stem in the stem-loop structure has also been described (PCT Publication WO 2002/00894).

Yet another variation includes using synthetic repeats to promote formation of a stem in the stem-loop structure. Transgenic organisms prepared with such recombinant DNA fragments have been shown to have reduced levels of the protein encoded by the nucleotide fragment forming the loop as described in PCT Publication WO 2002/00904.

RNA interference refers to the process of sequence-specific post-transcriptional gene silencing in animals mediated by short interfering RNAs (siRNAs) (Fire, et al., (1998) Nature 391:806). The corresponding process in plants is commonly referred to as post-transcriptional gene silencing (PTGS) or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire, et al., (1999) Trends Genet. 15:358). Such protection from foreign gene expression may have evolved in response to the production of double-stranded RNAs (dsRNAs) derived from viral infection or from the random integration of transposon elements into a host genome via a cellular response that specifically destroys homologous single-stranded RNA of viral genomic RNA. The presence of dsRNA in cells triggers the RNAi response through a mechanism that has yet to be fully characterized.

The presence of long dsRNAs in cells stimulates the activity of a ribonuclease III enzyme referred to as dicer. Dicer is involved in the processing of the dsRNA into short pieces of dsRNA known as short interfering RNAs (siRNAs) (Berstein, et al., (2001) Nature 409:363). Short interfering RNAs derived from dicer activity are typically about 21 to about 23 nucleotides in length and comprise about 19 base pair duplexes (Elbashir, et al., (2001) Genes Dev. 15:188). Dicer has also been implicated in the excision of 21- and 22-nucleotide small temporal RNAs (stRNAs) from precursor RNA of conserved structure that are implicated in translational control (Hutvagner, et al., (2001) Science 293:834). The RNAi response also features an endonuclease complex, commonly referred to as an RNA-induced silencing complex (RISC), which mediates cleavage of single-stranded RNA having sequence complementarity to the antisense strand of the siRNA duplex. Cleavage of the target RNA takes place in the middle of the region complementary to the antisense strand of the siRNA duplex (Elbashir, et al., (2001) Genes Dev. 15:188). In addition, RNA interference can also involve small RNA (e.g., miRNA) mediated gene silencing, presumably through cellular mechanisms that regulate chromatin structure and thereby prevent transcription of target gene sequences (see, e.g., Allshire, (2002) Science 297:1818-1819; Volpe, et al., (2002) Science 297:1833-1837; Jenuwein, (2002) Science 297:2215-2218 and Hall, et al., (2002) Science 297:2232-2237). As such, miRNA molecules of the disclosure can be used to mediate gene silencing via interaction with RNA transcripts or alternately by interaction with particular gene sequences, wherein such interaction results in gene silencing either at the transcriptional or post-transcriptional level.

Methods and compositions are further provided which allow for an increase in RNAi produced from the silencing element. In such embodiments, the methods and compositions employ a first polynucleotide comprising a silencing element for a target pest sequence operably linked to a promoter active in the plant cell; and, a second polynucleotide comprising a suppressor enhancer element comprising the target pest sequence or an active variant or fragment thereof operably linked to a promoter active in the plant cell. The combined expression of the silencing element with suppressor enhancer element leads to an increased amplification of the inhibitory RNA produced from the silencing element over that achievable with only the expression of the silencing element alone. In addition to the increased amplification of the specific RNAi species itself, the methods and compositions further allow for the production of a diverse population of RNAi species that can enhance the effectiveness of disrupting target gene expression. As such, when the suppressor enhancer element is expressed in a plant cell in combination with the silencing element, the methods and composition can allow for the systemic production of RNAi throughout the plant; the production of greater amounts of RNAi than would be observed with just the silencing element construct alone; and, the improved loading of RNAi into the phloem of the plant, thus providing better control of phloem feeding insects by an RNAi approach. Thus, the various methods and compositions provide improved methods for the delivery of inhibitory RNA to the target organism. See, for example, US Patent Application Publication 2009/0188008.

As used herein, a "suppressor enhancer element" comprises a polynucleotide comprising the target sequence to be suppressed or an active fragment or variant thereof. It is recognize that the suppressor enhancer element need not be identical to the target sequence, but rather, the suppressor enhancer element can comprise a variant of the target sequence, so long as the suppressor enhancer element has sufficient sequence identity to the target sequence to allow for an increased level of the RNAi produced by the silencing element over that achievable with only the expression of the silencing element. Similarly, the suppressor enhancer element can comprise a fragment of the target sequence, wherein the fragment is of sufficient length to allow for an increased level of the RNAi produced by the silencing element over that achievable with only the expression of the silencing element.

It is recognized that multiple suppressor enhancer elements from the same target sequence or from different target sequences or from different regions of the same target sequence can be employed. For example, the suppressor enhancer elements employed can comprise fragments of the target sequence derived from different region of the target sequence (i.e., from the 3'UTR, coding sequence, intron, and/or 5'UTR). Further, the suppressor enhancer element can be contained in an expression cassette, as described elsewhere herein, and in specific embodiments, the suppressor enhancer element is on the same or on a different DNA vector or construct as the silencing element. The suppressor enhancer element can be operably linked to a promoter as disclosed herein. It is recognized that the suppressor enhancer element can be expressed constitutively or alternatively, it may be produced in a stage-specific manner employing the various inducible or tissue-preferred or developmentally regulated promoters that are discussed elsewhere herein.

In specific embodiments, employing both a silencing element and the suppressor enhancer element the systemic production of RNAi occurs throughout the entire plant. In further embodiments, the plant or plant parts of the disclosure have an improved loading of RNAi into the phloem of the plant than would be observed with the expression of the silencing element construct alone and, thus provide better control of phloem feeding insects by an RNAi approach. In specific embodiments, the plants, plant parts and plant cells of the disclosure can further be characterized as allowing for the production of a diversity of RNAi species that can enhance the effectiveness of disrupting target gene expression.

In specific embodiments, the combined expression of the silencing element and the suppressor enhancer element increases the concentration of the inhibitory RNA in the plant cell, plant, plant part, plant tissue or phloem over the level that is achieved when the silencing element is expressed alone.

As used herein, an "increased level of inhibitory RNA" comprises any statistically significant increase in the level of RNAi produced in a plant having the combined expression when compared to an appropriate control plant. For example, an increase in the level of RNAi in the plant, plant part or the plant cell can comprise at least about a 1%, about a 1%-5%, about a 5%-10%, about a 10%-20%, about a 20%-30%, about a 30%-40%, about a 40%-50%, about a 50%-60%, about 60-70%, about 70%-80%, about a 80%-90%, about a 90%-100% or greater increase in the level of RNAi in the plant, plant part, plant cell or phloem when compared to an appropriate control. In other embodiments, the increase in the level of RNAi in the plant, plant part, plant cell or phloem can comprise at least about a 1 fold, about a 1 fold-5 fold, about a 5 fold-10 fold, about a 10 fold-20 fold, about a 20 fold-30 fold, about a 30 fold-40 fold, about a 40 fold-50 fold, about a 50 fold-60 fold, about 60 fold-70 fold, about 70 fold-80 fold, about a 80 fold-90 fold, about a 90 fold-100 fold or greater increase in the level of RNAi in the plant, plant part, plant cell or phloem when compared to an appropriate control. Examples of combined expression of the silencing element with suppressor enhancer element for the control of Stinkbugs and *Lygus* can be found in US Patent Application Publication 2011/0301223 and US Patent Application Publication 2009/0192117.

Some embodiments relate to down-regulation of expression of target genes in insect pest species by interfering ribonucleic acid (RNA) molecules. PCT Publication WO 2007/074405 describes methods of inhibiting expression of target genes in invertebrate pests including Colorado potato beetle. PCT Publication WO 2005/110068 describes methods of inhibiting expression of target genes in invertebrate pests including in particular Western corn rootworm as a means to control insect infestation. Furthermore, PCT Publication WO 2009/091864 describes compositions and methods for the suppression of target genes from insect pest species including pests from the *Lygus* genus. Nucleic acid molecules including RNAi for targeting the vacuolar ATPase H subunit, useful for controlling a coleopteran pest population and infestation as described in US Patent Application Publication 2012/0198586. PCT Publication WO 2012/055982 describes ribonucleic acid (RNA or double stranded RNA) that inhibits or down regulates the expression of a target gene that encodes: an insect ribosomal protein such as the ribosomal protein L19, the ribosomal protein L40 or the ribosomal protein S27A; an insect proteasome subunit such as the Rpn6 protein, the Pros 25, the Rpn2 protein, the proteasome beta 1 subunit protein or the Pros beta 2 protein; an insect β-coatomer of the COPI vesicle, the γ-coatomer of the COPI vesicle, the β'-coatomer protein or the ζ-coatomer of the COPI vesicle; an insect Tetraspanine 2 A protein which is a putative transmembrane domain protein; an insect protein belonging to the actin family such as Actin 5C; an insect ubiquitin-5E protein; an insect Sec23 protein which is a GTPase activator involved in intracellular protein transport; an insect crinkled protein which is an unconventional myosin which is involved in motor activity; an insect crooked neck protein which is involved in the regulation of nuclear alternative mRNA splicing; an insect vacuolar H+-ATPase G-subunit protein and an insect Tbp-1 such as Tat-binding protein. US Patent Application Publications 2012/029750, US 20120297501, and 2012/0322660 describe interfering ribonucleic acids (RNA or double stranded RNA) that functions upon uptake by an insect pest species to down-regulate expression of a target gene in said insect pest, wherein the RNA comprises at least one silencing element wherein the silencing element is a region of double-stranded RNA comprising annealed complementary strands, one strand of which comprises or consists of a sequence of nucleotides which is at least partially complementary to a target nucleotide sequence within the target gene. US Patent Application Publication 2012/0164205 describe potential targets for interfering double stranded ribonucleic acids for inhibiting invertebrate pests including: a Chd3 Homologous Sequence, a Beta-Tubulin Homologous Sequence, a 40 kDa V-ATPase Homologous Sequence, a EF1α Homologous Sequence, a 26S Proteosome Subunit p28 Homologous Sequence, a Juvenile Hormone Epoxide Hydrolase Homologous Sequence, a Swelling Dependent Chloride Channel Protein Homologous Sequence, a Glucose-6-Phosphate 1-Dehydrogenase Protein Homologous Sequence, an Act42A Protein Homologous Sequence, a ADP-Ribosylation Factor 1 Homologous Sequence, a Transcription Factor IIB Protein Homologous Sequence, a Chitinase Homologous Sequences, a Ubiquitin Conjugating Enzyme Homologous Sequence, a Glyceraldehyde-3-Phosphate Dehydrogenase Homologous Sequence, an Ubiquitin B Homologous Sequence, a Juvenile Hormone Esterase Homolog, and an Alpha Tubuliln Homologous Sequence.

Use in Pesticidal Control

General methods for employing strains comprising a nucleic acid sequence of the embodiments or a variant thereof, in pesticide control or in engineering other organisms as pesticidal agents are known in the art. See, for example U.S. Pat. No. 5,039,523 and EP 0480762A2.

Microorganism hosts that are known to occupy the "phytosphere" (phylloplane, phyllosphere, rhizosphere, and/or rhizoplana) of one or more crops of interest may be selected. These microorganisms are selected so as to be capable of successfully competing in the particular environment with the wild-type microorganisms, provide for stable maintenance and expression of the gene expressing the PtIP-83 polypeptide and desirably provide for improved protection of the pesticide from environmental degradation and inactivation.

Such microorganisms include bacteria, algae, and fungi. Of particular interest are microorganisms such as bacteria, e.g., *Pseudomonas, Erwinia, Serratia, Klebsiella, Xanthomonas, Streptomyces, Rhizobium, Rhodopseudomonas, Methylius, Agrobacterium, Acetobacter, Lactobacillus, Arthrobacter, Azotobacter, Leuconostoc,* and *Alcaligenes,* fungi, particularly yeast, e.g., *Saccharomyces, Cryptococcus, Kluyveromyces, Sporobolomyces, Rhodotorula,* and *Aureobasidium.* Of particular interest are such phytosphere bacterial species as *Pseudomonas syringae, Pseudomonas fluorescens, Pseudomonas chlororaphis, Serratia marcescens, Acetobacter xylinum, Agrobacteria, Rhodopseudomonas spheroides, Xanthomonas campestris, Rhizobium melioti, Alcaligenes entrophus, Clavibacter xyli* and *Azotobacter vinelandii* and phytosphere yeast species such as *Rhodotorula rubra, R. glutinis, R. marina, R. aurantiaca, Cryptococcus albidus, C. diffluens, C. laurentii, Saccharomyces rosei, S. pretoriensis, S. cerevisiae, Sporobolomyces roseus, S. odorus, Kluyveromyces veronae,* and *Aureobasidium pollulans.* Of particular interest are the pigmented microorganisms. Host organisms of particular interest include yeast, such as *Rhodotorula* spp., *Aureobasidium* spp., *Saccharomyces* spp. (such as *S. cerevisiae*), *Sporobolomyces* spp., phylloplane organisms such as *Pseudomonas* spp. (such as *P. aeruginosa, P. fluorescens, P. chlororaphis*), *Erwinia* spp., and *Flavobacterium* spp., and other such organisms, including *Agrobacterium tumefaciens, E. coli, Bacillus subtilis, Bacillus cereus* and the like.

Genes encoding the PtIP-83 polypeptide of the embodiments can be introduced into microorganisms that multiply on plants (epiphytes) to deliver PtIP-83 polypeptide to potential target pests. Epiphytes, for example, can be gram-positive or gram-negative bacteria.

Root-colonizing bacteria, for example, can be isolated from the plant of interest by methods known in the art. Specifically, a *Bacillus cereus* strain that colonizes roots can be isolated from roots of a plant (see, for example, Handelsman et al. (1991) *Appl. Environ. Microbiol.* 56:713-718). Genes encoding the PtIP-83 polypeptide of the embodiments can be introduced into a root-colonizing *Bacillus cereus* by standard methods known in the art.

Genes encoding PtIP-83 polypeptides can be introduced, for example, into the root-colonizing *Bacillus* by means of electro transformation. Specifically, genes encoding the PtIP-83 polypeptides can be cloned into a shuttle vector, for example, pHT3101 (Lerecius, et al., (1989) *FEMS Microbiol. Letts.* 60:211-218. The shuttle vector pHT3101 containing the coding sequence for the particular PtIP-83 polypeptide gene can, for example, be transformed into the root-colonizing *Bacillus* by means of electroporation (Lerecius, et al., (1989) *FEMS Microbiol. Letts.* 60:211-218).

Expression systems can be designed so that PtIP-83 polypeptides are secreted outside the cytoplasm of gram-negative bacteria, such as *E. coli,* for example. Advantages of having a PtIP-83 polypeptide secreted are: (1) avoidance of potential cytotoxic effects of the PtIP-83 polypeptide expressed; and (2) improvement in the efficiency of purification of the PtIP-83 polypeptide, including, but not limited to, increased efficiency in the recovery and purification of the protein per volume cell broth and decreased time and/or costs of recovery and purification per unit protein.

PtIP-83 polypeptides can be made to be secreted in *E. coli,* for example, by fusing an appropriate *E. coli* signal peptide to the amino-terminal end of the PtIP-83 polypeptide. Signal peptides recognized by *E. coli* can be found in proteins already known to be secreted in *E. coli,* for example the OmpA protein (Ghrayeb, et al., (1984) *EMBO J,* 3:2437-2442). OmpA is a major protein of the *E. coli* outer membrane, and thus its signal peptide is thought to be efficient in the translocation process. Also, the OmpA signal peptide does not need to be modified before processing as may be the case for other signal peptides, for example lipoprotein signal peptide (Duffaud, et al., (1987) *Meth. Enzymol.* 153: 492).

PtIP-83 polypeptides of the embodiments can be fermented in a bacterial host and the resulting bacteria processed and used as a microbial spray in the same manner that Bt strains have been used as insecticidal sprays. In the case of a PtIP-83 polypeptide(s that is secreted from *Bacillus,* the secretion signal is removed or mutated using procedures known in the art. Such mutations and/or deletions prevent secretion of the PtIP-83 polypeptide(s) into the growth medium during the fermentation process. The PtIP-83 polypeptide is retained within the cell, and the cells are then processed to yield the encapsulated PtIP-83 polypeptide. Any suitable microorganism can be used for this purpose. *Pseudomonas* has been used to express Bt toxins as encapsulated proteins and the resulting cells processed and sprayed as an insecticide (Gaertner, et al., (1993), in: *Advanced Engineered Pesticides,* ed. Kim).

Alternatively, the PtIP-83 polypeptide is produced by introducing a heterologous gene into a cellular host. Expression of the heterologous gene results, directly or indirectly, in the intracellular production and maintenance of the pesticide. These cells are then treated under conditions that prolong the activity of the toxin produced in the cell when the cell is applied to the environment of target pest(s). The resulting product retains the toxicity of the toxin. These naturally encapsulated PtIP-83 polypeptide may then be formulated in accordance with conventional techniques for application to the environment hosting a target pest, e.g., soil, water, and foliage of plants. See, for example EPA 0192319, and the references cited therein.

Pesticidal Compositions

In some embodiments the active ingredients can be applied in the form of compositions and can be applied to the crop area or plant to be treated, simultaneously or in succession, with other compounds. These compounds can be fertilizers, weed killers, Cryoprotectants, surfactants, detergents, pesticidal soaps, dormant oils, polymers, and/or time-release or biodegradable carrier formulations that permit long-term dosing of a target area following a single application of the formulation. They can also be selective herbicides, chemical insecticides, virucides, microbicides, amoebicides, pesticides, fungicides, bacteriocides, nematocides, molluscicides or mixtures of several of these preparations, if desired, together with further agriculturally acceptable carriers, surfactants or application-promoting adjuvants customarily employed in the art of formulation. Suitable carriers and adjuvants can be solid or liquid and correspond to the substances ordinarily employed in formulation technology, e.g. natural or regenerated mineral substances, solvents, dispersants, wetting agents, tackifiers, binders or fertilizers. Likewise the formulations may be prepared into edible "baits" or fashioned into pest "traps" to permit feeding or ingestion by a target pest of the pesticidal formulation.

Methods of applying an active ingredient or an agro-chemical composition that contains at least one of the PtIP-83 polypeptide produced by the bacterial strains include leaf application, seed coating and soil application.

The number of applications and the rate of application depend on the intensity of infestation by the corresponding pest.

The composition may be formulated as a powder, dust, pellet, granule, spray, emulsion, colloid, solution or such like, and may be prepared by such conventional means as desiccation, lyophilization, homogenation, extraction, filtration, centrifugation, sedimentation or concentration of a culture of cells comprising the polypeptide. In all such compositions that contain at least one such pesticidal polypeptide, the polypeptide may be present in a concentration of from about 1% to about 99% by weight.

Lepidopteran, Dipteran, Heteropteran, nematode, Hemiptera or Coleopteran pests may be killed or reduced in numbers in a given area by the methods of the disclosure or may be prophylactically applied to an environmental area to prevent infestation by a susceptible pest. Preferably the pest ingests or is contacted with, a pesticidally-effective amount of the polypeptide. "Pesticidally-effective amount" as used herein refers to an amount of the pesticide that is able to bring about death to at least one pest or to noticeably reduce pest growth, feeding or normal physiological development. This amount will vary depending on such factors as, for example, the specific target pests to be controlled, the specific environment, location, plant, crop or agricultural site to be treated, the environmental conditions and the method, rate, concentration, stability, and quantity of application of the pesticidally-effective polypeptide composition. The formulations may also vary with respect to climatic conditions, environmental considerations, and/or frequency of application and/or severity of pest infestation.

The pesticide compositions described may be made by formulating either the bacterial cell, Crystal and/or spore suspension or isolated protein component with the desired agriculturally-acceptable carrier. The compositions may be formulated prior to administration in an appropriate means such as lyophilized, freeze-dried, desiccated or in an aqueous carrier, medium or suitable diluent, such as saline or other buffer. The formulated compositions may be in the form of a dust or granular material or a suspension in oil (vegetable or mineral) or water or oil/water emulsions or as a wettable powder or in combination with any other carrier material suitable for agricultural application. Suitable agricultural carriers can be solid or liquid and are well known in the art. The term "agriculturally-acceptable carrier" covers all adjuvants, inert components, dispersants, surfactants, tackifiers, binders, etc. that are ordinarily used in pesticide formulation technology; these are well known to those skilled in pesticide formulation. The formulations may be mixed with one or more solid or liquid adjuvants and prepared by various means, e.g., by homogeneously mixing, blending and/or grinding the pesticidal composition with suitable adjuvants using conventional formulation techniques. Suitable formulations and application methods are described in U.S. Pat. No. 6,468,523, herein incorporated by reference. The plants can also be treated with one or more chemical compositions, including one or more herbicide, insecticides or fungicides. Exemplary chemical compositions include: Fruits/Vegetables Herbicides: Atrazine, Bromacil, Diuron, Glyphosate, Linuron, Metribuzin, Simazine, Trifluralin, Fluazifop, Glufosinate, Halo sulfuron Gowan, Paraquat, Propyzamide, Sethoxydim, Butafenacil, Halosulfuron, Indaziflam; Fruits/Vegetables Insecticides: Aldicarb, *Bacillus thuriengiensis*, Carbaryl, Carbofuran, Chlorpyrifos, Cypermethrin, Deltamethrin, Diazinon, Malathion, Abamectin, Cyfluthrin/beta-cyfluthrin, Esfenvalerate, Lambda-cyhalothrin, Acequinocyl, Bifenazate, Methoxyfenozide, Novaluron, Chromafenozide, Thiacloprid, Dinotefuran, FluaCrypyrim, Tolfenpyrad, Clothianidin, Spirodiclofen, Gamma-cyhalothrin, Spiromesifen, Spinosad, Rynaxypyr, Cyazypyr, Spinoteram, Triflumuron, Spirotetramat, Imidacloprid, Flubendiamide, Thiodicarb, Metaflumizone, Sulfoxaflor, Cyflumetofen, Cyanopyrafen, Imidacloprid, Clothianidin, Thiamethoxam, Spinotoram, Thiodicarb, Flonicamid, Methiocarb, Emamectin-benzoate, Indoxacarb, Forthiazate, Fenamiphos, Cadusaphos, Pyriproxifen, Fenbutatin-oxid, Hexthiazox, Methomyl, 4-[[(6-Chlorpyridin-3-yl)methyl](2,2-difluorethyl)amino]furan-2(5H)-on; Fruits/Veqetables Fungicides: Carbendazim, Chlorothalonil, EBDCs, Sulphur, Thiophanate-methyl, Azoxystrobin, Cymoxanil, Fluazinam, Fosetyl, Iprodione, Kresoxim-methyl, Metalaxyl/mefenoxam, Trifloxystrobin, Ethaboxam, Iprovalicarb, Trifloxystrobin, Fenhexamid, Oxpoconazole fumarate, Cyazofamid, Fenamidone, Zoxamide, Picoxystrobin, Pyraclostrobin, Cyflufenamid, Boscalid; Cereals Herbicides: Isoproturon, Bromoxynil, Ioxynil, Phenoxies, Chlorsulfuron, Clodinafop, Diclofop, Diflufenican, Fenoxaprop, Florasulam, Fluoroxypyr, Metsulfuron, Triasulfuron, Flucarbazone, Iodosulfuron, Propoxycarbazone, Picolinafen, Mesosulfuron, Beflubutamid, Pinoxaden, Amidosulfuron, Thifensulfuron Methyl, Tribenuron, Flupyrsulfuron, Sulfosulfuron, Pyrasulfotole, Pyroxsulam, Flufenacet, Tralkoxydim, Pyroxasulfon; Cereals Fungicides: Carbendazim, Chlorothalonil, Azoxystrobin, Cyproconazole, Cyprodinil, Fenpropimorph, Epoxiconazole, Kresoxim-methyl, Quinoxyfen, Tebuconazole, Trifloxystrobin, Simeconazole, Picoxystrobin, Pyraclostrobin, Dimoxystrobin, Prothioconazole, Fluoxastrobin; Cereals Insecticides: Dimethoate, Lambda-cyhalthrin, Deltamethrin, alpha-Cypermethrin, β-cyfluthrin, Bifenthrin, Imidacloprid, Clothianidin, Thiamethoxam, Thiacloprid, Acetamiprid, Dinetofuran, Clorphyriphos, Metamidophos, Oxidemethon-methyl, Pirimicarb, Methiocarb; Maize Herbicides: Atrazine, Alachlor, Bromoxynil, Acetochlor, Dicamba, Clopyralid, (S—) Dimethenamid, Glufosinate, Glyphosate, Isoxaflutole, (S-)Metolachlor, Mesotrione, Nicosulfuron, Primisulfuron, Rimsulfuron, Sulcotrione, Foramsulfuron, Topramezone, Tembotrione, Saflufenacil, Thiencarbazone, Flufenacet, Pyroxasulfon; Maize Insecticides: Carbofuran, Chlorpyrifos, Bifenthrin, Fipronil, Imidacloprid, Lambda-Cyhalothrin, Tefluthrin, Terbufos, Thiamethoxam, Clothianidin, Spiromesifen, Flubendiamide, Triflumuron, Rynaxypyr, Deltamethrin, Thiodicarb, β-Cyfluthrin, Cypermethrin, Bifenthrin, Lufenuron, Triflumoron, Tefluthrin, Tebupirimphos, Ethiprole, Cyazypyr, Thiacloprid, Acetamiprid, Dinetofuran, Avermectin, Methiocarb, Spirodiclofen, Spirotetramat; Maize Fungicides: Fenitropan, Thiram, Prothioconazole, Tebuconazole, Trifloxystrobin; Rice Herbicides: Butachlor, Propanil, Azimsulfuron, Bensulfuron, Cyhalofop, Daimuron, Fentrazamide, Imazosulfuron, Mefenacet, Oxaziclomefone, Pyrazosulfuron, Pyributicarb, Quinclorac, Thiobencarb, Indanofan, Flufenacet, Fentrazamide, Halosulfuron, Oxaziclomefone, Benzobicyclon, Pyriftalid, Penoxsulam, Bispyribac, Oxadiargyl, Ethoxysulfuron, Pretilachlor, Mesotrione, Tefuryltrione, Oxadiazone, Fenoxaprop, Pyrimisulfan; Rice Insecticides: Diazinon, Fenitrothion, Fenobucarb, Monocrotophos, Benfuracarb, Buprofezin, Dinotefuran, Fipronil, Imidacloprid, Isoprocarb, Thiacloprid, Chromafenozide, Thiacloprid, Dinotefuran, Clothianidin, Ethiprole, Flubendiamide, Rynaxypyr, Deltamethrin, Acetamiprid, Thiamethoxam, Cyazypyr, Spinosad, Spinotoram, Emamectin-Benzoate, Cypermethrin, Chlorpyriphos, Cartap, Methamidophos, Etofenprox, Triazophos, 4-[[(6-Chlorpyridin-3-yl)methyl](2,2-difluorethyl)amino]furan-2(5H)-on, Carbofuran, Benfuracarb; Rice Fungicides: Thiophanate-methyl, Azoxystrobin, Carpropamid, Edifenphos, Ferimzone, Iprobenfos, Isoprothiolane, Pencycuron, Probenazole, Pyroquilon, Tricyclazole, Trifloxystrobin, Diclocymet, Fenoxanil, Simeconazole, Tiadinil; Cotton Herbicides: Diuron, Fluometuron, MSMA, Oxyfluorfen, Prometryn, Trifluralin, Carfentrazone, Clethodim, Fluazifop-butyl, Glyphosate, Norflurazon, Pendimethalin, Pyrithiobac-sodium, Trifloxysulfuron, Tepraloxydim, Glufosinate, Flumioxazin, Thidiazuron; Cotton Insecticides: Acephate, Aldicarb, Chlorpyrifos, Cypermethrin, Deltamethrin, Malathion, Monocrotophos, Abamectin, Acetamiprid, Emamectin Benzoate, Imidacloprid, Indoxacarb, Lambda-Cyhalothrin, Spinosad, Thiodicarb, Gamma-Cyhalothrin, Spiromesifen, Pyridalyl, Flonicamid, Flubendiamide, Triflumuron, Rynaxypyr, Beta-Cyfluthrin, Spirotetramat, Clothianidin, Thiamethoxam, Thiacloprid, Dinetofuran, Flubendiamide, Cyazypyr, Spinosad, Spinotoram, gamma Cyhalothrin, 4-[[(6-Chlorpyridin-3-yl)methyl](2,2-difluoroethyl)amino]furan-2(5H)-on, Thiodicarb, Avermectin, Flonicamid, Pyridalyl, Spiromesifen, Sulfoxaflor, Profenophos, Thriazophos, Endosulfan; Cotton Fungicides: Etridiazole, Metalaxyl, Quintozene; Soybean Herbicides: Alachlor, Bentazone, Trifluralin, Chlorimuron-Ethyl, Cloransulam-Methyl, Fenoxaprop, Fomesafen, Fluazifop, Glyphosate, Imazamox, Imazaquin, Imazethapyr, (S-)Metolachlor, Metribuzin, Pendimethalin, Tepraloxydim, Glufosinate; Soybean Insecticides: Lambda-cyhalothrin, Methomyl, Parathion, Thiocarb, Imidacloprid, Clothianidin, Thiamethoxam, Thiacloprid, Acetamiprid, Dinetofuran, Flubendiamide, Rynaxypyr, Cyazypyr, Spinosad, Spinotoram, Emamectin-Benzoate, Fipronil, Ethiprole, Deltamethrin, 13-Cyfluthrin, gamma and lambda Cyhalothrin, 4-[[(6-Chlorpyridin-3-yl)methyl](2,2-difluoroethyl)amino]furan-2(5H)-on, Spirotetramat, Spinodiclofen, Triflumuron, Flonicamid, Thiodicarb, beta-Cyfluthrin; Soybean Fungicides: Azoxystrobin, Cyproconazole, Epoxiconazole, Flutriafol, Pyraclostrobin, Tebuconazole, Trifloxystrobin, Prothioconazole, Tetraconazole; Sugarbeet Herbicides: Chloridazon, Desmedipham, Ethofumesate, Phenmedipham, Triallate, Clopyralid, Fluazifop, Lenacil, Metamitron, Quinmerac, Cycloxydim, Triflusulfuron, Tepraloxydim, Quizalofop; Sugarbeet Insecticides: Imidacloprid, Clothianidin, Thiamethoxam, Thiacloprid, Acetamiprid, Dinetofuran, Deltamethrin, 13-Cyfluthrin, gamma/lambda Cyhalothrin, 4-[[(6-Chlorpyridin-3-yl)methyl](2,2-difluoroethyl)amino]furan-2(5H)-on, Tefluthrin, Rynaxypyr, Cyaxypyr, Fipronil, Carbofuran; Canola Herbicides: Clopyralid, Diclofop, Fluazifop, Glufosinate, Glyphosate, Metazachlor, Trifluralin Ethametsulfuron, Quinmerac, Quizalofop, Clethodim, Tepraloxydim; Canola Fungicides: Azoystrobin, Carbendazim, Fludioxonil, Iprodione, Prochloraz, Vinclozolin; Canola Insecticides: Carbofuran organophosphates, Pyrethroids, Thiacloprid, Deltamethrin, Imidacloprid, Clothianidin, Thiamethoxam, Acetamiprid, Dinetofuran, 13-Cyfluthrin, gamma and lambda Cyhalothrin, tau-Fluvaleriate, Ethiprole, Spinosad, Spinotoram, Flubendiamide, Rynaxypyr, Cyazypyr, 4-[[(6-Chlorpyridin-3-yl)methyl](2,2-difluoroethyl)amino]furan-2(5H)-on.

In some embodiments the herbicide is Atrazine, Bromacil, Diuron, Chlorsulfuron, Metsulfuron, Thifensulfuron Methyl, Tribenuron, Acetochlor, Dicamba, Isoxaflutole, Nicosulfuron, Rimsulfuron, Pyrithiobac-sodium, Flumioxazin, Chlorimuron-Ethyl, Metribuzin, Quizalofop, S-metolachlor, Hexazinne or combinations thereof.

In some embodiments the insecticide is Esfenvalerate, Chlorantraniliprole, Methomyl, Indoxacarb, Oxamyl or combinations thereof.

Pesticidal and Insecticidal Activity

"Pest" includes but is not limited to, insects, fungi, bacteria, nematodes, mites, ticks and the like. Insect pests include insects selected from the orders Coleoptera, Diptera, Hymenoptera, Lepidoptera, Mallophaga, Homoptera, Hemiptera Orthroptera, Thysanoptera, Dermaptera, Isoptera, Anoplura, Siphonaptera, Trichoptera, etc., particularly Lepidoptera and Coleoptera.

Those skilled in the art will recognize that not all compounds are equally effective against all pests. Compounds of the embodiments display activity against insect pests, which may include economically important agronomic, forest, greenhouse, nursery ornamentals, food and fiber, public and animal health, domestic and commercial structure, household and stored product pests.

Larvae of the order Lepidoptera include, but are not limited to, armyworms, cutworms, loopers and heliothines in the family Noctuidae *Spodoptera frugiperda* JE Smith (fall armyworm); *S. exigua* Hübner (beet armyworm); *S. litura* Fabricius (tobacco cutworm, cluster caterpillar); *Mamestra configurata* Walker (bertha armyworm); *M. brassicae* Linnaeus (cabbage moth); *Agrotis ipsilon* Hufnagel (black cutworm); *A. orthogonia* Morrison (western cutworm); *A. subterranea* Fabricius (granulate cutworm); *Alabama argillacea* Hübner (cotton leaf worm); *Trichoplusia ni* Hübner (cabbage looper); *Pseudoplusia includens* Walker (soybean looper); *Anticarsia gemmatalis* Hübner (velvetbean caterpillar); *Hypena scabra* Fabricius (green cloverworm); *Heliothis virescens* Fabricius (tobacco budworm); *Pseudaletia unipuncta* Haworth (armyworm); *Athetis mindara* Barnes and Mcdunnough (rough skinned cutworm); *Euxoa messoria* Harris (darksided cutworm); *Earias insulana* Boisduval (spiny bollworm); *E. vittella* Fabricius (spotted bollworm); *Helicoverpa armigera* Hübner (American bollworm); *H. zea* Boddie (corn earworm or cotton bollworm); *Melanchra picta* Harris (zebra caterpillar); *Egira (Xylomyges) curialis* Grote (citrus cutworm); borers, casebearers, webworms, coneworms, and skeletonizers from the family Pyralidae *Ostrinia nubilalis* Hübner (European corn borer); *Amyelois transitella* Walker (naval orangeworm); *Anagasta kuehniella* Zeller (Mediterranean flour moth); *Cadra cautella* Walker (almond moth); *Chilo suppressalis* Walker (rice stem borer); *C. partellus*, (sorghum borer); *Corcyra cephalonica* Stainton (rice moth); *Crambus caliginosellus* Clemens (corn root webworm); *C. teterrellus* Zincken (bluegrass webworm); *Cnaphalocrocis medinalis* Guenée (rice leaf roller); *Desmia funeralis* Hübner (grape leaffolder); *Diaphania hyalinata* Linnaeus (melon worm); *D. nitidalis* Stoll (pickleworm); *Diatraea grandiosella* Dyar (southwestern corn borer), *D. saccharalis* Fabricius (surgarcane borer); *Eoreuma loftini* Dyar (Mexican rice borer); *Ephestia elutella* Hübner (tobacco (cacao) moth); *Galleria mellonella* Linnaeus (greater wax moth); *Herpetogramma licarsisalis* Walker (sod webworm); *Homoeosoma electellum* Hulst (sunflower moth); *Elasmopalpus lignosellus* Zeller (lesser cornstalk borer); *Achroia grisella* Fabricius (lesser wax moth); *Loxostege sticticalis* Linnaeus (beet webworm); *Orthaga thyrisalis* Walker (tea tree web moth); *Maruca testulalis* Geyer (bean pod borer); *Plodia interpunctella* Hübner (Indian meal moth); *Scirpophaga incertulas* Walker (yellow stem borer); *Udea rubigalis* Guenée (celery leaftier); and leafrollers, budworms, seed worms and fruit worms in the family Tortricidae *Acleris gloverana* Walsingham (Western blackheaded budworm); *A. variana* Fernald (Eastern blackheaded budworm); *Archips argyrospila* Walker (fruit tree leaf roller); *A. rosana* Linnaeus (European leaf roller); and other *Archips* species, *Adoxophyes orana* Fischer von Rösslerstamm (summer fruit tortrix moth); *Cochylis hospes* Walsingham (banded sunflower moth); *Cydia latiferreana* Walsingham (filbertworm); *C. pomonella* Linnaeus (coding moth); *Platynota flavedana* Clemens (variegated leafroller); *P. stultana* Walsingham (omnivorous leafroller); *Lobesia botrana* Denis & Schiffermüller (European grape vine moth); *Spilonota ocellana* Denis & Schiffermüller (eyespotted bud moth); *Endopiza viteana* Clemens (grape berry moth); *Eupoecilia ambiguella* Hübner (vine moth); *Bonagota salubricola* Meyrick (Brazilian apple leafroller); *Grapholita molesta* Busck (oriental fruit moth); *Suleima helianthana* Riley (sunflower bud moth); *Argyrotaenia* spp.; *Choristoneura* spp.

Selected other agronomic pests in the order Lepidoptera include, but are not limited to, *Alsophila pometaria* Harris (fall cankerworm); *Anarsia lineatella* Zeller (peach twig borer); *Anisota senatoria* J. E. Smith (orange striped oakworm); *Antheraea pernyi* Guérin-Méneville (Chinese Oak Tussah Moth); *Bombyx mori* Linnaeus (Silkworm); *Bucculatrix thurberiella* Busck (cotton leaf perforator); *Colias eurytheme* Boisduval (alfalfa caterpillar); *Datana integerrima* Grote & Robinson (walnut caterpillar); *Dendrolimus sibiricus* Tschetwerikov (Siberian silk moth), *Ennomos subsignaria* Hübner (elm spanworm); *Erannis tiliaria* Harris (linden looper); *Euproctis chrysorrhoea* Linnaeus (browntail moth); *Harrisina americana* Guérin-Méneville (grapeleaf skeletonizer); *Hemileuca oliviae* Cockrell (range caterpillar); *Hyphantria cunea* Drury (fall webworm); *Keiferia lycopersicella* Walsingham (tomato pinworm); *Lambdina fiscellaria fiscellaria* Hulst (Eastern hemlock looper); *L. fiscellaria lugubrosa* Hulst (Western hemlock looper); *Leucoma salicis* Linnaeus (satin moth); *Lymantria dispar* Linnaeus (gypsy moth); *Manduca quinquemaculata* Haworth (five spotted hawk moth, tomato hornworm); *M. sexta* Haworth (tomato hornworm, tobacco hornworm); *Operophtera brumata* Linnaeus (winter moth); *Paleacrita vernata* Peck (spring cankerworm); *Papilio cresphontes* Cramer (giant swallowtail orange dog); *Phryganidia californica* Packard (California oakworm); *Phyllocnistis citrella* Stainton (citrus leafminer); *Phyllonorycter blancardella* Fabricius (spotted tentiform leafminer); *Pieris brassicae* Linnaeus (large white butterfly); *P. rapae* Linnaeus (small white butterfly); *P. napi* Linnaeus (green veined white butterfly); *Platyptilia carduidactyla* Riley (artichoke plume moth); *Plutella xylostella* Linnaeus (diamondback moth); *Pectinophora gossypiella* Saunders (pink bollworm); *Pontia protodice* Boisduval and Leconte (Southern cabbageworm); *Sabulodes aegrotata* Guenée (omnivorous looper); *Schizura concinna* J. E. Smith (red humped caterpillar); *Sitotroga cerealella* Olivier (Angoumois grain moth); *Thaumetopoea pityocampa* Schiffermuller (pine processionary caterpillar); *Tineola bisselliella* Hummel (webbing clothesmoth); *Tuta absoluta* Meyrick (tomato leafminer); *Yponomeuta padella* Linnaeus (ermine moth); *Heliothis subflexa* Guenée; *Malacosoma* spp. and *Orgyia* spp.

Of interest are larvae and adults of the order Coleoptera including weevils from the families Anthribidae, Bruchidae and Curculionidae (including, but not limited to: *Anthonomus grandis* Boheman (boll weevil); *Lissorhoptrus oryzophilus* Kuschel (rice water weevil); *Sitophilus granarius* Linnaeus (granary weevil); *S. oryzae* Linnaeus (rice weevil); *Hypera punctata* Fabricius (clover leaf weevil); *Cylindrocopturus adspersus* LeConte (sunflower stem weevil); *Smicronyx fulvus* LeConte (red sunflower seed weevil); *S. sordidus* LeConte (gray sunflower seed weevil); *Sphenophorus maidis* Chittenden (maize billbug)); flea beetles, cucumber beetles, rootworms, leaf beetles, potato beetles and leafminers in the family Chrysomelidae (including, but not limited to: *Leptinotarsa decemlineata* Say (Colorado potato beetle); *Diabrotica virgifera virgifera* LeConte (western corn rootworm); *D. barberi* Smith and Lawrence (northern corn rootworm); *D. undecimpunctata howardi* Barber (southern corn rootworm); *Chaetocnema pulicaria* Melsheimer (corn flea beetle); *Phyllotreta cruciferae* Goeze (Crucifer flea beetle); *Phyllotreta striolata* (stripped flea beetle); *Colaspis brunnea* Fabricius (grape *colaspis*); *Oulema melanopus* Linnaeus (cereal leaf beetle); *Zygogramma exclamationis* Fabricius (sunflower beetle)); beetles from the family Coccinellidae (including, but not limited to: *Epilachna varivestis* Mulsant (Mexican bean beetle)); chafers and other beetles from the family Scarabaeidae (including, but not limited to: *Popillia japonica* Newman (Japanese beetle); *Cyclocephala borealis* Arrow (northern masked chafer, white grub); *C. immaculata* Olivier (southern masked chafer, white grub); *Rhizotrogus majalis* Razoumowsky (European chafer); *Phyllophaga crinita* Burmeister (white grub); *Ligyrus gibbosus* De Geer (carrot beetle)); carpet beetles from the family Dermestidae; wireworms from the family Elateridae, *Eleodes* spp., *Melanotus* spp.; *Conoderus* spp.; *Limonius* spp.; *Agriotes* spp.; *Ctenicera* spp.; *Aeolus* spp.; bark beetles from the family Scolytidae and beetles from the family Tenebrionidae.

Adults and immatures of the order Diptera are of interest, including leafminers *Agromyza parvicornis* Loew (corn blotch leafminer); midges (including, but not limited to: *Contarinia sorghicola* Coquillett (sorghum midge); *Mayetiola destructor* Say (Hessian fly); *Sitodiplosis mosellana* Géhin (wheat midge); *Neolasioptera murtfeldtiana* Felt, (sunflower seed midge)); fruit flies (Tephritidae), *Oscinella frit* Linnaeus (fruit flies); maggots (including, but not limited to: *Delia platura* Meigen (seedcorn maggot); *D. coarctata* Fallen (wheat bulb fly) and other *Delia* spp., *Meromyza americana* Fitch (wheat stem maggot); *Musca domestica* Linnaeus (house flies); *Fannia canicularis* Linnaeus, *F. femoralis* Stein (lesser house flies); *Stomoxys calcitrans* Linnaeus (stable flies)); face flies, horn flies, blow flies, *Chrysomya* spp.; *Phormia* spp. and other muscoid fly pests, horse flies *Tabanus* spp.; bot flies *Gastrophilus* spp.; *Oestrus* spp.; cattle grubs *Hypoderma* spp.; deer flies *Chrysops* spp.; *Melophagus ovinus* Linnaeus (keds) and other *Brachycera*, mosquitoes *Aedes* spp.; *Anopheles* spp.; *Culex* spp.; black flies *Prosimulium* spp.; *Simulium* spp.; biting midges, sand flies, sciarids, and other *Nematocera*.

Included as insects of interest are adults and nymphs of the orders Hemiptera and Homoptera such as, but not limited to, adelgids from the family Adelgidae, plant bugs from the family Miridae, cicadas from the family Cicadidae, leafhoppers, *Empoasca* spp.; from the family Cicadellidae, planthoppers from the families Cixiidae, Flatidae, Fulgoroidea, Issidae and Delphacidae, treehoppers from the family Membracidae, psyllids from the family Psyllidae, whiteflies from the family Aleyrodidae, aphids from the family Aphididae, *phylloxera* from the family Phylloxeridae, mealybugs from the family Pseudococcidae, scales from the families Asterolecanidae, Coccidae, Dactylopiidae, Diaspididae, Eriococcidae Ortheziidae, Phoenicococcidae and Margarodidae, lace bugs from the family Tingidae, stink bugs from the family Pentatomidae, cinch bugs, *Blissus* spp.; and other seed bugs from the family Lygaeidae, spittlebugs from the family Cercopidae squash bugs from the family *Coreidae* and red bugs and cotton stainers from the family *Pyrrhocoridae*.

Agronomically important members from the order Homoptera further include, but are not limited to: *Acyrthisiphon pisum* Harris (pea aphid); *Aphis craccivora* Koch (cowpea aphid); *A. fabae* Scopoli (black bean aphid); *A. gossypii* Glover (cotton aphid, melon aphid); *A. maidiradicis* Forbes (corn root aphid); *A. pomi* De Geer (apple aphid); *A. spiraecola* Patch (spirea aphid); *Aulacorthum solani* Kaltenbach (foxglove aphid); *Chaetosiphon fragaefolii* Cockerell (strawberry aphid); *Diuraphis noxia* Kurdjumov/Mordvilko (Russian wheat aphid); *Dysaphis plantaginea* Paaserini (rosy apple aphid); *Eriosoma lanigerum* Hausmann (woolly apple aphid); *Brevicoryne brassicae* Linnaeus (cabbage aphid); *Hyalopterus pruni* Geoffroy (mealy plum aphid); *Lipaphis erysimi* Kaltenbach (turnip aphid); *Metopolophium dirrhodum* Walker (cereal aphid); *Macrosiphum euphorbiae* Thomas (potato aphid); *Myzus persicae* Sulzer (peach-potato aphid, green peach aphid); *Nasonovia ribisnigri* Mosley (lettuce aphid); *Pemphigus* spp. (root aphids and gall aphids); *Rhopalosiphum maidis* Fitch (corn leaf aphid); *R. padi* Linnaeus (bird cherry-oat aphid); *Schizaphis graminum* Rondani (greenbug); *Sipha flava* Forbes (yellow sugarcane aphid); *Sitobion avenae* Fabricius (English grain aphid); *Therioaphis maculata* Buckton (spotted alfalfa aphid); *Toxoptera aurantii* Boyer de Fonscolombe (black citrus aphid) and *T. citricida* Kirkaldy (brown citrus aphid); *Adelges* spp. (adelgids); *Phylloxera devastatrix* Pergande (pecan *phylloxera*); *Bemisia tabaci* Gennadius (tobacco whitefly, sweetpotato whitefly); *B. argentifolii* Bellows & Perring (silverleaf whitefly); *Dialeurodes citri* Ashmead (citrus whitefly); *Trialeurodes abutiloneus* (bandedwinged whitefly) and *T. vaporariorum* Westwood (greenhouse whitefly); *Empoasca fabae* Harris (potato leafhopper); *Laodelphax striatellus* Fallen (smaller brown planthopper); *Macrolestes quadrilineatus* Forbes (aster leafhopper); *Nephotettix cinticeps* Uhler (green leafhopper); *N. nigropictus* Stal (rice leafhopper); *Nilaparvata lugens* Stal (brown planthopper); *Peregrinus maidis* Ashmead (corn planthopper); *Sogatella furcifera* Horvath (white-backed planthopper); *Sogatodes orizicola* Muir (rice delphacid); *Typhlocyba pomaria* McAtee (white apple leafhopper); *Erythroneoura* spp. (grape leafhoppers); *Magicicada septendecim* Linnaeus (periodical cicada); *Icerya purchasi* Maskell (cottony cushion scale); *Quadraspidiotus perniciosus* Comstock (San Jose scale); *Planococcus citri* Risso (citrus mealybug); *Pseudococcus* spp. (other mealybug complex); *Cacopsylla pyricola* Foerster (pear *psylla*); *Trioza diospyri* Ashmead (persimmon *psylla*).

Agronomically important species of interest from the order Hemiptera include, but are not limited to: *Acrosternum hilare* Say (green stink bug); *Anasa tristis* De Geer (squash bug); *Blissus leucopterus leucopterus* Say (chinch bug); *Corythuca gossypii* Fabricius (cotton lace bug); *Cyrtopeltis modesta* Distant (tomato bug); *Dysdercus suturellus* Herrich-Schaffer (cotton stainer); *Euschistus servus* Say (brown stink bug); *E. variolarius* Palisot de Beauvois (one-spotted stink bug); *Graptostethus* spp. (complex of seed bugs); *Leptoglossus corculus* Say (leaf-footed pine seed bug); *Lygus lineolaris* Palisot de Beauvois (tarnished plant bug); *L. Hesperus* Knight (Western tarnished plant bug); *L. pratensis* Linnaeus (common meadow bug); *L. rugulipennis* Poppius (European tarnished plant bug); *Lygocoris pabulinus* Linnaeus (common green capsid); *Nezara viridula* Linnaeus (southern green stink bug); *Oebalus pugnax* Fabricius (rice stink bug); *Oncopeltus fasciatus* Dallas (large milkweed bug); *Pseudatomoscelis seriatus* Reuter (cotton fleahopper).

Furthermore, embodiments may be effective against Hemiptera such, *Calocoris norvegicus* Gmelin (strawberry bug); *Orthops campestris* Linnaeus; *Plesiocoris rugicollis* Fallen (apple capsid); *Cyrtopeltis modestus* Distant (tomato bug); *Cyrtopeltis notatus* Distant (suckfly); *Spanagonicus albofasciatus* Reuter (whitemarked fleahopper); *Diaphnocoris chlorionis* Say (honeylocust plant bug); *Labopidicola allii* Knight (onion plant bug); *Pseudatomoscelis seriatus* Reuter (cotton fleahopper); *Adelphocoris rapidus* Say (rapid plant bug); *Poecilocapsus lineatus* Fabricius (four-lined plant bug); *Nysius ericae* Schilling (false chinch bug); *Nysius raphanus* Howard (false chinch bug); *Nezara viridula* Linnaeus (Southern green stink bug); *Eurygaster* spp.; *Coreidae* spp.; *Pyrrhocoridae* spp.; *Tinidae* spp.; *Blostomatidae* spp.; *Reduviidae* spp. and *Cimicidae* spp.

Also included are adults and larvae of the order Acari (mites) such as *Aceria tosichella* Keifer (wheat curl mite); *Petrobia latens* MOller (brown wheat mite); spider mites and red mites in the family Tetranychidae, *Panonychus ulmi* Koch (European red mite); *Tetranychus urticae* Koch (two spotted spider mite); (*T. mcdanieli* McGregor (McDaniel mite); *T. cinnabarinus* Boisduval (carmine spider mite); *T. turkestani* Ugarov & Nikolski (strawberry spider mite); flat mites in the family Tenuipalpidae, *Brevipalpus lewisi* McGregor (citrus flat mite); rust and bud mites in the family Eriophyidae and other foliar feeding mites and mites important in human and animal health, i.e., dust mites in the family Epidermoptidae, follicle mites in the family Demodicidae, grain mites in the family Glycyphagidae, ticks in the order Ixodidae: *Ixodes scapularis* Say (deer tick); *I. holocyclus* Neumann (Australian paralysis tick); *Dermacentor variabilis* Say (American dog tick); *Amblyomma americanum* Linnaeus (lone star tick) and scab and itch mites in the families Psoroptidae, Pyemotidae and Sarcoptidae.

Insect pests of the order Thysanura are of interest, such as *Lepisma saccharina* Linnaeus (silverfish); *Thermobia domestica* Packard (firebrat).

Additional arthropod pests covered include: spiders in the order Araneae such as *Loxosceles reclusa* Gertsch and Mulaik (brown recluse spider) and the *Latrodectus mactans* Fabricius (black widow spider) and centipedes in the order Scutigeromorpha such as *Scutigera coleoptrata* Linnaeus (house centipede).

Insect pest of interest include the superfamily of stink bugs and other related insects including but not limited to species belonging to the family Pentatomidae (*Nezara viridula, Halyomorpha halys, Piezodorus guildini, Euschistus servus, Acrosternum hilare, Euschistus heros, Euschistus tristigmus, Acrosternum hilare, Dichelops furcatus, Dichelops melacanthus*, and *Bagrada hilaris* (*Bagrada* Bug)), the family Plataspidae (*Megacopta cribraria*—Bean plataspid) and the family Cydnidae (*Scaptocoris castanea*—Root stink bug) and Lepidoptera species including but not limited to: diamond-back moth, e.g., *Helicoverpa zea* Boddie; soybean looper, e.g., *Pseudoplusia includens* Walker and velvet bean caterpillar e.g., *Anticarsia gemmatalis* Hübner.

Methods for measuring pesticidal activity are well known in the art. See, for example, Czapla and Lang, (1990) *J. Econ. Entomol.* 83:2480-2485; Andrews, et al., (1988) *Biochem. J.* 252:199-206; Marrone, et al., (1985) *J. of Economic Entomology* 78:290-293 and U.S. Pat. No. 5,743,477, all of which are herein incorporated by reference in their entirety. Generally, the protein is mixed and used in feeding assays. See, for example Marrone, et al., (1985) *J. of Economic Entomology* 78:290-293. Such assays can include contacting plants with one or more pests and determining the plant's ability to survive and/or cause the death of the pests.

Nematodes include parasitic nematodes such as root-knot, cyst and lesion nematodes, including *Heterodera* spp., *Meloidogyne* spp. and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode) and *Globodera rostochiensis* and *Globodera pailida* (potato cyst nematodes). Lesion nematodes include *Pratylenchus* spp.

Seed Treatment

To protect and to enhance yield production and trait technologies, seed treatment options can provide additional crop plan flexibility and cost effective control against insects, weeds and diseases. Seed material can be treated, typically surface treated, with a composition comprising combinations of chemical or biological herbicides, herbicide safeners, insecticides, fungicides, germination inhibitors and enhancers, nutrients, plant growth regulators and activators, bactericides, nematocides, avicides and/or molluscicides. These compounds are typically formulated together with further carriers, surfactants or application-promoting adjuvants customarily employed in the art of formulation. The coatings may be applied by impregnating propagation material with a liquid formulation or by coating with a combined wet or dry formulation. Examples of the various types of compounds that may be used as seed treatments are provided in The Pesticide Manual: A World Compendium, C. D. S. Tomlin Ed., Published by the British Crop Production Council, which is hereby incorporated by reference.

Some seed treatments that may be used on crop seed include, but are not limited to, one or more of abscisic acid, acibenzolar-S-methyl, avermectin, amitrol, azaconazole, azospirillum, azadirachtin, azoxystrobin, *Bacillus* spp. (including one or more of *cereus, firmus, megaterium, pumilis, sphaericus, subtilis* and/or *thuringiensis* species), *bradyrhizobium* spp. (including one or more of *betae, canariense, elkanii, iriomotense, japonicum, liaonigense, pachyrhizi* and/or *yuanmingense*), captan, carboxin, chitosan, clothianidin, copper, cyazypyr, difenoconazole, etidiazole, fipronil, fludioxonil, fluoxastrobin, fluquinconazole, flurazole, fluxofenim, harpin protein, imazalil, imidacloprid, ipconazole, isoflavenoids, lipo-chitooligosaccharide, mancozeb, manganese, maneb, mefenoxam, metalaxyl, metconazole, myclobutanil, PCNB, penflufen, *penicillium*, penthiopyrad, permethrine, picoxystrobin, prothioconazole, pyraclostrobin, rynaxypyr, S-metolachlor, saponin, sedaxane, TCMTB, tebuconazole, thiabendazole, thiamethoxam, thiocarb, thiram, tolclofos-methyl, triadimenol, *trichoderma*, trifloxystrobin, triticonazole and/or zinc. PCNB seed coat refers to EPA Registration Number 00293500419, containing quintozen and terrazole. TCMTB refers to 2-(thiocyanomethylthio) benzothiazole.

Seed varieties and seeds with specific transgenic traits may be tested to determine which seed treatment options and application rates may complement such varieties and transgenic traits in order to enhance yield. For example, a variety with good yield potential but head smut susceptibility may benefit from the use of a seed treatment that provides protection against head smut, a variety with good yield potential but cyst nematode susceptibility may benefit from the use of a seed treatment that provides protection against cyst nematode, and so on. Likewise, a variety encompassing a transgenic trait conferring insect resistance may benefit from the second mode of action conferred by the seed treatment, a variety encompassing a transgenic trait conferring herbicide resistance may benefit from a seed treatment with a safener that enhances the plants resistance to that herbicide, etc. Further, the good root establishment and early emergence that results from the proper use of a seed treatment may result in more efficient nitrogen use, a better ability to withstand drought and an overall increase in yield potential of a variety or varieties containing a certain trait when combined with a seed treatment.

Methods for Killing an Insect Pest and Controlling an Insect Population

In some embodiments methods are provided for killing an insect pest, comprising contacting the insect pest with an insecticidally-effective amount of a recombinant PtIP-83 polypeptide. In some embodiments methods are provided for killing an insect pest, comprising contacting the insect pest with an insecticidally-effective amount of a recombinant pesticidal protein of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, SEQ ID NO: 769 or a variant thereof.

In some embodiments methods are provided for killing an insect pest, comprising contacting the insect pest with an insecticidally-effective amount of a recombinant PtIP-83 polypeptide of SEQ ID NO: 236-299, SEQ ID NO: 334-367, SEQ ID NO: 398-427, SEQ ID NO: 518-607, SEQ ID NO: 640-645, and SEQ ID NO: 728-737.

In some embodiments methods are provided for killing an insect pest, comprising contacting the insect pest with an insecticidally-effective amount of a recombinant PtIP-83 polypeptide comprising an amino acid sequence of any one of SEQ ID NO: 786-888 or a variant thereof.

In some embodiments methods are provided for controlling an insect pest population, comprising contacting the insect pest population with an insecticidally-effective amount of a recombinant PtIP-83 polypeptide. In some embodiments methods are provided for controlling an insect pest population, comprising contacting the insect pest population with an insecticidally-effective amount of a recombinant PtIP-83 polypeptide of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, SEQ ID NO: 769 or a variant thereof. As used herein, "controlling a pest population" or "controls a pest" refers to any effect on a pest that results in limiting the damage that the pest causes. Controlling a pest includes, but is not limited to, killing the pest, inhibiting development of the pest, altering fertility or growth of the pest in such a manner that the pest provides less damage to the plant, decreasing the number of offspring produced, producing less fit pests, producing pests more susceptible to predator attack or deterring the pests from eating the plant.

In some embodiments methods are provided for controlling an insect pest population, comprising contacting the insect pest population with an insecticidally-effective amount of a recombinant PtIP-83 polypeptide of any one of SEQ ID NO: 236-299, SEQ ID NO: 334-367, SEQ ID NO: 398-427, SEQ ID NO: 518-607, SEQ ID NO: 640-645, and SEQ ID NO: 728-737.

In some embodiments methods are provided for controlling an insect pest population, comprising contacting the insect pest population with an insecticidally-effective amount of a recombinant PtIP-83 polypeptide of any one of SEQ ID NO: 786-888 or a variant thereof.

In some embodiments methods are provided for protecting a plant from an insect pest, comprising expressing in the plant or cell thereof at least one recombinant polynucleotide encoding a PtIP-83 polypeptide. In some embodiments methods are provided for protecting a plant from an insect pest, comprising expressing in the plant or cell thereof a recombinant polynucleotide encoding a PtIP-83 polypeptide of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768 or SEQ ID NO: 769 or variants thereof.

In some embodiments methods are provided for protecting a plant from an insect pest, comprising expressing in the plant or cell thereof at least one recombinant polynucleotide encoding a PtIP-83 polypeptide. In some embodiments methods are provided for protecting a plant from an insect pest, comprising expressing in the plant or cell thereof a recombinant polynucleotide encoding a PtIP-83 polypeptide of any one of SEQ ID NO: 236-299, SEQ ID NO: 334-367, SEQ ID NO: 398-427, SEQ ID NO: 518-607, SEQ ID NO: 640-645, and SEQ ID NO: 728-737.

In some embodiments methods are provided for protecting a plant from an insect pest, comprising expressing in the plant or cell thereof at least one recombinant polynucleotide encoding a PtIP-83 polypeptide. In some embodiments methods are provided for protecting a plant from an insect pest, comprising expressing in the plant or cell thereof a recombinant polynucleotide encoding a PtIP-83 polypeptide of any one of SEQ ID NO: 786-888 or a variant thereof.

Insect Resistance Management (IRM) Strategies

Expression of *B. thuringiensis* δ-endotoxins in transgenic corn plants has proven to be an effective means of controlling agriculturally important insect pests (Perlak, et al., 1990; 1993). However, insects have evolved that are resistant to *B. thuringiensis* δ-endotoxins expressed in transgenic plants. Such resistance, should it become widespread, would clearly limit the commercial value of germplasm containing genes encoding such *B. thuringiensis* δ-endotoxins.

One way to increasing the effectiveness of the transgenic insecticides against target pests and contemporaneously reducing the development of insecticide-resistant pests is to use provide non-transgenic (i.e., non-insecticidal protein) refuges (a section of non-insecticidal crops/corn) for use with transgenic crops producing a single insecticidal protein active against target pests. The United States Environmental Protection Agency (epa.gov/oppbppdl/biopesticides/pips/bt_corn_refuge_2006.htm, which can be accessed using the www prefix) publishes the requirements for use with transgenic crops producing a single Bt protein active against target pests. In addition, the National Corn Growers Association, on their website: (ncga.com/insect-resistance-management-fact-sheet-bt-corn, which can be accessed using the www prefix) also provides similar guidance regarding refuge requirements. Due to losses to insects within the refuge area, larger refuges may reduce overall yield.

Another way of increasing the effectiveness of the transgenic insecticides against target pests and contemporaneously reducing the development of insecticide-resistant pests would be to have a repository of insecticidal genes that are effective against groups of insect pests and which manifest their effects through different modes of action.

Expression in a plant of two or more insecticidal compositions toxic to the same insect species, each insecticide being expressed at efficacious levels would be another way to achieve control of the development of resistance. This is based on the principle that evolution of resistance against two separate modes of action is far more unlikely than only one. Roush, for example, outlines two-toxin strategies, also called "pyramiding" or "stacking," for management of insecticidal transgenic crops. (The Royal Society. Phil. Trans. R. Soc. Lond. B. (1998) 353:1777-1786). Stacking or pyramiding of two different proteins each effective against the target pests and with little or no cross-resistance can allow for use of a smaller refuge. The US Environmental Protection Agency requires significantly less (generally 5%) structured refuge of non-Bt corn be planted than for single trait products (generally 20%). There are various ways of providing the IRM effects of a refuge, including various geometric planting patterns in the fields and in-bag seed mixtures, as discussed further by Roush.

In some embodiments the PtIP-83 polypeptide of the disclosure are useful as an insect resistance management strategy in combination (i.e., pyramided) with other pesticidal proteins include but are not limited to Bt toxins, *Xenorhabdus* sp. or *Photorhabdus* sp. insecticidal proteins, and the like.

Provided are methods of controlling Lepidoptera and/or Coleoptera insect infestation(s) in a transgenic plant that promote insect resistance management, comprising expressing in the plant at least two different insecticidal proteins having different modes of action.

In some embodiments the methods of controlling Lepidoptera and/or Coleoptera insect infestation in a transgenic plant and promoting insect resistance management the at least one of the insecticidal proteins comprise a PtIP-83 polypeptide insecticidal to insects in the order Lepidoptera and/or Coleoptera.

In some embodiments the methods of controlling Lepidoptera and/or Coleoptera insect infestation in a transgenic plant and promoting insect resistance management the at least one of the insecticidal proteins comprises a PtIP-83 polypeptide of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, SEQ ID NO: 769 or variants thereof, insecticidal to insects in the order Lepidoptera and/or Coleoptera.

In some embodiments the methods of controlling Lepidoptera and/or Coleoptera insect infestation in a transgenic plant and promoting insect resistance management the at least one of the insecticidal proteins comprises a PtIP-83 polypeptide of any one of SEQ ID NO: 236-299, SEQ ID NO: 334-367, SEQ ID NO: 398-427, SEQ ID NO: 518-607, SEQ ID NO: 640-645, and SEQ ID NO: 728-737.

In some embodiments the methods of controlling Lepidoptera and/or Coleoptera insect infestation in a transgenic plant and promoting insect resistance management comprise expressing in the transgenic plant a PtIP-83 polypeptide and a Cry protein insecticidal to insects in the order Lepidoptera and/or Coleoptera having different modes of action.

In some embodiments the methods of controlling Lepidoptera and/or Coleoptera insect infestation of a transgenic plant and promoting insect resistance management comprise in the transgenic plant a PtIP-83 polypeptide of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, SEQ ID NO: 769 or variants thereof and a Cry protein insecticidal to insects in the order Lepidoptera and/or Coleoptera having different modes of action.

Also provided are methods of reducing likelihood of emergence of Lepidoptera and/or Coleoptera insect resistance to transgenic plants expressing in the plants insecticidal proteins to control the insect species, comprising expression of a PtIP-83 polypeptide insecticidal to the insect species in combination with a second insecticidal protein to the insect species having different modes of action.

Also provided are means for effective Lepidoptera and/or Coleoptera insect resistance management of transgenic plants, comprising co-expressing at high levels in the plants two or more insecticidal proteins toxic to Lepidoptera and/or Coleoptera insects but each exhibiting a different mode of effectuating its killing activity, wherein the two or more insecticidal proteins comprise a PtIP-83 polypeptide and a Cry protein. Also provided are means for effective Lepidoptera and/or Coleoptera insect resistance management of transgenic plants, comprising co-expressing at high levels in the plants two or more insecticidal proteins toxic to Lepidoptera and/or Coleoptera insects but each exhibiting a different mode of effectuating its killing activity, wherein the two or more insecticidal proteins comprise a PtIP-83 polypeptide of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, SEQ ID NO: 769 or variants thereof and a Cry protein.

In addition, methods are provided for obtaining regulatory approval for planting or commercialization of plants expressing proteins insecticidal to insects in the order Lepidoptera and/or Coleoptera, comprising the step of referring to, submitting or relying on insect assay binding data showing that the PtIP-83 polypeptide does not compete with binding sites for Cry proteins in such insects. In addition, methods are provided for obtaining regulatory approval for planting or commercialization of plants expressing proteins insecticidal to insects in the order Lepidoptera and/or Coleoptera, comprising the step of referring to, submitting or relying on insect assay binding data showing that the PtIP-83 polypeptide of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 716, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, SEQ ID NO: 769 or variant thereof does not compete with binding sites for Cry proteins in such insects.

Methods for Increasing Plant Yield

Methods for increasing plant yield are provided. The methods comprise providing a plant or plant cell expressing a polynucleotide encoding the pesticidal polypeptide sequence disclosed herein and growing the plant or a seed thereof in a field infested with a pest against which the polypeptide has pesticidal activity. In some embodiments, the polypeptide has pesticidal activity against a Lepidopteran, Coleopteran, Dipteran, Hemipteran or nematode pest, and the field is infested with a Lepidopteran, Hemipteran, Coleopteran, Dipteran or nematode pest.

As defined herein, the "yield" of the plant refers to the quality and/or quantity of biomass produced by the plant. "Biomass" as used herein refers to any measured plant product. An increase in biomass production is any improvement in the yield of the measured plant product. Increasing plant yield has several commercial applications. For example, increasing plant leaf biomass may increase the yield of leafy vegetables for human or animal consumption. Additionally, increasing leaf biomass can be used to increase production of plant-derived pharmaceutical or industrial products. An increase in yield can comprise any statistically significant increase including, but not limited to, at least a 1% increase, at least a 3% increase, at least a 5% increase, at least a 10% increase, at least a 20% increase, at least a 30%, at least a 50%, at least a 70%, at least a 100% or a greater increase in yield compared to a plant not expressing the pesticidal sequence.

In specific methods, plant yield is increased as a result of improved pest resistance of a plant expressing a PtIP-83 polypeptide disclosed herein. Expression of the PtIP-83 polypeptide results in a reduced ability of a pest to infest or feed on the plant, thus improving plant yield.

Methods of Processing

Further provided are methods of processing a plant, plant part or seed to obtain a food or feed product from a plant, plant part or seed comprising a PtIP-83 polypeptide. The plants, plant parts or seeds provided herein, can be processed to yield oil, protein products and/or by-products that are derivatives obtained by processing that have commercial value. Non-limiting examples include transgenic seeds comprising a nucleic acid molecule encoding a PtIP-83 polypeptide which can be processed to yield soy oil, soy products and/or soy by-products.

"Processing" refers to any physical and chemical methods used to obtain any soy product and includes, but is not limited to, heat conditioning, flaking and grinding, extrusion, solvent extraction or aqueous soaking and extraction of whole or partial seeds The following examples are offered by way of illustration and not by way of limitation.

EXPERIMENTALS

Example 1—Identification of an Insecticidal Protein Active Against Broad Spectrum of Lepidopteran Insects from the Fern, *Adiantum pedatum*, (PS-7140)

The insecticidal protein PtIP-83Aa (SEQ ID NO: 1) was identified by protein purification, mass spectroscopy (MS) and PCR cloning from *Adiantum pedatum*, (PS-7140) as follows.

*Adiantum pedatum* was collected by a collaborator and assigned identification number PS-7140. PS-7140 was collected, flash frozen in liquid $N_2$ and stored at −80° C. After storage it was ground to a fine powder at liquid $N_2$ temperatures with a Geno Ball Mill (SPEX, Metuchen, N.J.). To extract protein, 20 mL of 50 mM Tris buffer, pH 8.0, 150 mM KCl, 2.5 mM EDTA, 1.5% polyvinylpolypyrrolidone (PVPP) and protease inhibitor cocktail (Roche Diagnostics, Germany) was added to every 5 g fresh weight of tissue. The homogenate was centrifuged to remove cell debris, filtered through 0.22 um filters and desalted using 10 ml Zeba Spin Desalting columns (Thermo Scientific, IL.)

Bioassays against the three pest species, Soybean Looper (SBL) (*Chrysodeixis includens*), Corn Earworm (CEW) (*Helicoverpa zea*) and European Corn Borer (ECB) (*Ostrinia nubilalis*) were conducted using the desalted protein extract overlaid onto an agar-based Lepidoptera diet (Southland Products Inc., Lake Village, Ark.) in a 96-well plate format. Six replicates were used per sample. Samples were allowed to dry on top of the diet and two to five neonate insects were placed into each well of the treated plate. After four days of incubation at 27° C. larvae were scored for mortality or severity of stunting. The scores were recorded numerically as dead (3), severely stunted (2) (little or no growth but alive and equivalent to a 1$^{st}$ instar larvae), stunted (1) (growth to second instar but not equivalent to controls), or normal (0). Subjecting the sample to proteinase K and heat treatments resulted in loss of activity indicating that the active principle was proteinaceous in nature. Bioassay results are shown in Table 6.

TABLE 6

Activity of *A. pedatum* crude protein extract against Lepidoptera larvae

| | | Ave. Score | Ave. Score after Proteinase K/Heat |
|---|---|---|---|
| Neonate | Soybean Looper | 3 | 0 |
| | Corn Earworm | 2 | 0 |
| | European Corn Borer | 1.5 | 0 |

For protein purification, PS-7140 fronds were ground to a fine powder at liquid $N_2$ temperatures with a Geno Ball Mill (SPEX, Metuchen, N.J.). Protein was extracted in 100 mM Tris buffer, pH 8.0, 150 mM KCl, 2.5 mM EDTA, 1.5% PVPP and protease inhibitor cocktail (Roche Diagnostics, Germany). The extracted material was centrifuged to remove cell debris, filtered through Miracloth™ (Calbiochem) and then ammonium sulfate added to 35% and allowed to equilibrate. The suspension was centrifuged and the resulting pellet was resuspended in a small volume of 20 mM Tris buffer, pH 8. After clarification by centrifugation it was desalted using a Sephadex G25 column (GE, Piscataway, N.J.) equilibrated in 20 mM Tris buffer, pH 8. The desalted protein fraction pool was loaded onto a 1 ml Mono Q column (GE, Piscataway, N.J.) and eluted with a linear (60 CV (column volumes) gradient from 0 M to 0.7 M NaCl in 20 mM Tris, pH 8.0: Fractions active against SBL and ECB were combined and desalted into 25 mM MOPS, pH 6.7. This was then loaded onto a 4 mL Mono P column (Buffer A: 25 mM MOPS, pH 6.7; Buffer B: Polybuffer 74, pH 4) using a 4 CV linear gradient (0% Buffer B) followed by a 15 CV 100% Buffer B wash. 1 mL fractions were collected. Fractions 47 and 48 showed activity against ECB and SBL. Based on LDS-PAGE these active fractions contained a protein band at approximately 95 kDa. The protein representing the 95 kDa band was named PtIP-83Aa (SEQ ID NO: 1).

Protein identification was performed by MS analysis after protein digestion with trypsin. Proteins for MS identification were obtained after running the sample on an LDS-PAGE gel stained with Brilliant Blue G-250 Stain. Bands of interest were excised from the gel, de-stained, reduced with dithiothreitol and then alkylated with iodoacetamide. Following overnight digestion with trypsin, samples were analyzed by nano-liquid chromatography/electrospray tandem mass spectrometry (nano-LC/ES-MSMS) on a Thermo Q Exactive Orbitrap mass spectrometer (Thermo Fisher Scientific) interfaced with an Eksigent NanoLC Ultra 1-D Plus nano-lc system and a nanolc-as2 autosampler (AB Sciex). The protein identification was performed by searching the nano-LC/MSMS data against an in-house transcriptome database containing the transcripts from the source plant materials and the public protein database Swiss-Prot using the Mascot search engine (Matrix Science).

The amino acid sequence of SEQ ID NO: 1 was BLAST (Basic Local Alignment Search Tool; Altschul, et al., (1993) *J. Mol. Biol.* 215:403-410; see also ncbi.nlm.nih.gov/BLAST/, which can be accessed using the www prefix) searched against public and DUPONT-PIONEER internal databases that included plant protein sequences. Amino acid sequences were aligned with proteins in a proprietary DUPONT-PIONEER plant protein database.

Example 2 Transcriptomic Sequencing of PtIP-83Aa

A transcriptome for *Adiantum pedatum*, PS-7140 was prepared as follows. Total RNAs were isolated from frozen tissues by use of the Qiagen® RNeasy® kit for total RNA isolation. Sequencing libraries from the resulting total RNAs were prepared using the TruSeq™ mRNA-Seq kit and protocol from Illumina®, Inc. (San Diego, Calif.). Briefly, mRNAs were isolated via attachment to oligo(dT) beads, fragmented to a mean size of 180 nt, reverse transcribed into cDNA by random hexamer prime, end repaired, 3' A-tailed, and ligated with Illumina® indexed TruSeq™ adapters. Ligated cDNA fragments were PCR amplified using Illumina® TruSeq™ primers and purified PCR products were checked for quality and quantity on the Agilent Bioanalyzer® DNA 7500 chip. Post quality and quantity assessment, 100 ng of the transcript library was normalized by treatment with Duplex Specific Nuclease (DSN) (Evrogen®, Moscow, Russia). Normalization was accomplished by addition of 200 mM Hepes buffer, followed by heat denaturation and five hour anneal at 68° C. Annealed library was treated with 2 ul of DSN enzyme for 25 minutes, purified by Qiagen® MinElute® columns according to manufacturer protocols, and amplified twelve cycles using Illumina® adapter specific primers. Final products were purified with Ampure® XP beads (Beckman Genomics, Danvers, Mass.) and checked for quality and quantity on the Agilent Bioanalyzer® DNA 7500 chip.

Normalized transcript libraries were sequenced according to manufacturer protocols on the Illumina® Genome Analyzer IIx. Each library was hybridized to two flow cell lanes and amplified, blocked, linearized and primer hybridized using the Illumina clonal cluster generation process on cBot®. Sequencing was completed on the Genome Analyzer IIx, generating sixty million 75 bp paired end reads per normalized library.

Peptide sequence identified for PtIP-83Aa (SEQ ID NO: 1) by LC-MS/MS/MS sequencing (described in Example 1) were searched against the protein sequences predicted by open reading frames (ORFs) from the internal transcriptome for PS-7140CF assemblies. The peptides gave a perfect match to a transcript corresponding to PtIP-83Aa (SEQ ID NO: 2). The coding sequences were used to design the following primers to clone the PtIP-83Aa coding sequence:

```
(95KD N-T Nco I for)
                                     (SEQ ID NO: 30)
CCATGGCTCTCGTGGATTACGGCAAG
and (95KD C-T Hpa I REV)
                                     (SEQ ID NO: 31)
GTTAACCTACTCTTCGTCGTGCCGCCAGTC.
```

This clone was produced by polymerase chain reaction using the KOD Hot Start DNA Polymerase® PCR kit (Novagen, Merck KGaA, Darmstadt, Germany) and the total RNA from *Adiantum pedatum* as a template. The cloned PCR product was confirmed by sequencing.

Based on the DNA and protein sequencing, the PtIP-83Aa polynucleotide sequence is shown as SEQ ID NO: 2 and the polypeptide sequence as SEQ ID NO: 1.

Example 3—Identification of PtIP-83 Homologs

Gene identities may be determined by conducting BLAST® (Basic Local Alignment Search Tool; Altschul, et al., (1993) *J. Mol. Biol.* 215:403-410; see also ncbi.nlm.nih.gov/BLAST/, which can be accessed using the www prefix) searches under default parameters for similarity to sequences. The polynucleotide sequence for PtIP-83Aa (SEQ ID NO: 2) was analyzed. No close homologs of PtIP-83Aa (SEQ ID NO: 1) were identified in public databases.

Gene identities conducted by BLAST® in a DUPONT PIONEER internal transcriptome database of ferns and other primitive plants identified homologs for PtIP-83Aa (SEQ ID NO: 1). The PtIP-83Aa homologs and the organism they were identified from are shown in Table 7.

TABLE 7

| | Sequence id no | Source | Organism |
|---|---|---|---|
| PtIP-83Aa | SEQ ID NO: 1 | PS-7140 | *Adiantum pedatum* |
| PtIP-83Ca | SEQ ID NO: 5 | PS-11481 | *Adiantum trapeziforme* var. *braziliense* |
| PtIP-83Cb | SEQ ID NO: 7 | PS-11481 | *Adiantum trapeziforme* var. *braziliense* |
| PtIP-83Cc | SEQ ID NO: 9 | PS-11481 | *Adiantum trapeziforme* var. *braziliense* |
| PtIP-83Cd | SEQ ID NO: 11 | PS-11481 | *Adiantum trapeziforme* var. *braziliense* |
| PtIP-83Ce | SEQ ID NO: 13 | PS-12345 | *Adiantum peruvianum* |

TABLE 7-continued

| | Sequence id no | Source | Organism |
|---|---|---|---|
| PtIP-83Cf | SEQ ID NO: 15 | PS-9224 | *Lygodium flexuosum* |
| PtIP-83Cg | SEQ ID NO: 17 | PS-12345 | *Adiantum peruvianum* |
| PtIP-83Da | SEQ ID NO: 19 | PS-12345 | *Adiantum peruvianum* |
| PtIP-83Ea | SEQ ID NO: 21 | PS-11481 | *Adiantum trapeziforme* var. *braziliense* |
| PtIP-83Eb | SEQ ID NO: 23 | PS-11481 | *Adiantum trapeziforme* var. *braziliense* |
| PtIP-83Fa | SEQ ID NO: 3 | PS-8568 | *Microsorum musifolium* |
| PtIP-83Fb | SEQ ID NO: 716 | PS-9319 | *Polypodium punctatum* 'Serratum' |
| PtIP-83Ch | SEQ ID NO: 754 | LW13327 | *Polystichium tsus-simense* |
| PtIP-83Ch-like | SEQ ID NO: 755 | LW13327 | *Polystichium tsus-simense* |
| PtIP-83Fd | SEQ ID NO: 756 | LW13327 | *Polystichium tsus-simense* |
| PtIP-83Fe | SEQ ID NO: 757 | LW13327 | *Polystichium tsus-simense* |
| PtIP-83Ci | SEQ ID NO: 758 | LW12354 | *Rumohra adiantiformis* |
| PtIP-83Ci-like | SEQ ID NO: 759 | LW12354 | *Rumohra adiantiformis* |
| PtIP-83Ff | SEQ ID NO: 760 | LW12354 | *Rumohra adiantiformis* |
| PtIP-83Ff-like | SEQ ID NO: 761 | LW12354 | *Rumohra adiantiformis* |
| PtIP-83Cj | SEQ ID NO: 762 | NY012 | *Asplenium trichomanes* |
| PtIP-83Cj-like | SEQ ID NO: 763 | NY012 | *Asplenium trichomanes* |
| PtIP-83Ga | SEQ ID NO: 764 | NY009 | *Phyllitis scolopendium* 'Angustifolia' |
| PtIP-83Ga-like | SEQ ID NO: 765 | NY009 | *Phyllitis scolopendium* 'Angustifolia' |
| PtIP-83Fg | SEQ ID NO: 766 | NY009 | *Phyllitis scolopendium* 'Angustifolia' |
| PtIP-83Fh | SEQ ID NO: 767 | NY009 | *Phyllitis scolopendium* 'Angustifolia' |
| PtIP-83Fi | SEQ ID NO: 768 | NY009 | *Phyllitis scolopendium* 'Angustifolia' |
| PtIP-83Fi-like | SEQ ID NO: 769 | NY009 | *Phyllitis scolopendium* 'Angustifolia' | cDNA was generated from source organisms with identified homologs by reverse transcription from total RNA. Homologs were PCR amplified from their respective cDNAs using primers designed to the coding sequences of each homolog and subcloned into a plant transient vector containing the DMMV promoter. Cloned PCR products were confirmed by sequencing. Cloning primers are shown in Table 8. The cDNA for homolog PtIP-83Fb was synthesized (SEQ ID NO: 717) based on the transcriptome assembly of PS-9319 and subcloned into a plant transient vector.

TABLE 8

| Gene | Primer | Sequence |
|---|---|---|
| PtIP-83Cb | GZ-550-83Ca-F | CGAAATCTCTCATCTA AGAGGCTGGATCCTAG GATGGATTACAGCACG CTTTACAGGGAC (SEQ ID NO: 608) |
| PtIP-83Cb | GZ-550-83Ca-R | TTAAGTTGGCCAATCC AGAAGATGGACAAGTC TAGACTACTCCTCCTC TTGCCGCCAGTC (SEQ ID NO: 609) |
| PtIP-83Ca, Cc, and Cd | GZ-550-83Ca-F | CGAAATCTCTCATCTA AGAGGCTGGATCCTAG GATGGATTACAGCACG CTTTACAGGGAC (SEQ ID NO: 608) |
| PtIP-83Ca, Cc, and Cd | 83Ca-1s-R | CAA GGA TTG CAT TGC TAG GAA GG (SEQ ID NO: 611) |

TABLE 8-continued

| Gene | Primer | Sequence |
| --- | --- | --- |
| PtIP-83Ca, Cc, and Cd | GZ-550-83Ca-R | TTAAGTTGGCCAATCC AGAAGATGGACAAGTC TAGACTACTCCTCCTC TTGCCGCCAGTC (SEQ ID NO: 609) |
| PtIP-83Ca, Cc, and Cd | 83Ca-1s | CCTTCCTAGCAATGCA ATCCTTG (SEQ ID NO: 613) |
| PtIP-83Ce | GZ-550-83Ca-F | CGAAATCTCTCATCTA AGAGGCTGGATCCTAG GATGGATTACAGCACG CTTTACAGGGAC (SEQ ID NO: 608) |
| PtIP-83Ce | 550-12345-R | AAGTTGGCCAATCCAG AAGATGGACAAGTCTA GACTACTCCTCCTCTT TCTCCTCCTGCC (SEQ ID NO: 615) |
| PtIP-83Cf | 550-9224-F1 | CGAAATCTCTCATCTA AGAGGCTGGATCCTAG GATGGCCAGTGTACTG GATTACAGCAC (SEQ ID NO: 616) |
| PtIP-83Cf | 550-9224-R1 | TTAAGTTGGCCAATCC AGAAGATGGACAAGTC TAGACTACTCCTCCTC GTGCCGCC (SEQ ID NO: 617) |
| PtIP-83Cg | 550-11790.2-F | GAAATCTCTCATCTAA GAGGCTGGATCCTAGG ATGGATTACAGCACTC TTTACAGGGATC (SEQ ID NO: 618) |
| PtIP-83Cg | GZ-550-83Ca-R | TTAAGTTGGCCAATCC AGAAGATGGACAAGTC TAGACTACTCCTCCTC TTGCCGCCAGTC (SEQ ID NO: 609) |
| PtIP-83Da | GZ-550-83Ca-F | CGAAATCTCTCATCTA AGAGGCTGGATCCTAG GATGGATTACAGCACG CTTTACAGGGAC (SEQ ID NO: 608) |
| PtIP-83Da | 550-UTR8.7-R | GTTGGCCAATCCAGAA GATGGACAAGTCTAGA TTAGAGTGGCTTCGCC AGTGTCG (SEQ ID NO: 621) |
| PtIP-83Ea | GZ-550-83Ca-F | CGAAATCTCTCATCTA AGAGGCTGGATCCTAG GATGGATTACAGCACG CTTTACAGGGAC (SEQ ID NO: 608) |
| PtIP-83Ea | 550-12345-R | AAGTTGGCCAATCCAG AAGATGGACAAGTCTA GACTACTCCTCCTCTT TCTCCTCCTGCC (SEQ ID NO: 615) |
| PtIP-83Eb | GZ-550-83Ca-F | CGAAATCTCTCATCTA AGAGGCTGGATCCTAG GATGGATTACAGCACG CTTTACAGGGAC (SEQ ID NO: 608) |
| PtIP-83Eb | 550-12345-R | AAGTTGGCCAATCCAG AAGATGGACAAGTCTA GACTACTCCTCCTCTT TCTCCTCCTGCC (SEQ ID NO: 615) |
| PtIP-83Fa | infusion bamHI | TTTAACTTAGCCTAGG ATCCATGGAATATAGC AGCTTGTAC (SEQ ID NO: 32) |
| PtIP-83Fa | infusion HpaI | ACTCCTTCTTTAGTTA ACTTACTCCACATCAC CCTCTTGTCG (SEQ ID NO: 33) |
| PtIP-83Ch and PtIP-83Ch-like | LW13327-F1 | cgaaatctctcatcta agaggctggatcctag gATGGATTACAGCACG CTTTACAGG (SEQ ID NO: 770) |
| PtIP-83Ch and PtIP-83Ch-like | LW13327-R1 | taagttggccaatcca gaagatggacaagtct agaCTACTCCTCACC TCCTGCCTCC (SEQ ID NO: 771) |
| PtIP-83Fd and PtIP-83Fe | LW13327-F2 | cgaaatctctcatcta agaggctggatcctag gATGACGATGGCGGCA ACTG (SEQ ID NO: 772) |
| PtIP-83Fd and PtIP-83Fe | LW13327-R2 | ggccaatccagaagat ggacaagtctagaCTA GAAAGAAATTTTCCTG ATAGCTGAG (SEQ ID NO: 773) |
| PtIP-83Ci and PtIP-83Ci-like | LW12354-F1 | cgaaatctctcatcta agaggctggatcctag gATGGATTACAGCACT CTTTACACGG (SEQ ID NO: 774) |
| PtIP-83Ci and PtIP-83Ci-like | LW12354-R1 | taagttggccaatcca gaagatggacaagtct agaCTACTCCTCTTGC CGCCAGTC (SEQ ID NO: 775) |
| PtIP-83Ff and PtIP-83Ff-like | LW12354-E2 | cgaaatctctcatcta agaggctggatcctag gATGGCTGCCTCCGCT GCTG (SEQ ID NO: 776) |
| PtIP-83Ff and PtIP-83Ff-like | LW12354-R2 | taagttggccaatcca gaagatggacaagtct agaCTAGAAAGAAATG CGCCGGATAG (SEQ ID NO: 777) |
| PtIP-83Cj and PtIP-83Cj-like | NY012-F1 | cgaaatctctcatcta agaggctggatcctag gATGGATTACAGCACG CTTTACAGG (SEQ ID NO: 778) |
| PtIP-83Cj and PtIP-83Cj-like | NY012-R1 | taagttggccaatcca gaagatggacaagtct agaCTACTCCTCCTCC TCCTCGTGCC (SEQ ID NO: 779) |

TABLE 8-continued

| Gene | Primer | Sequence |
|---|---|---|
| PtIP-83Ga and PtIP-83Ga-like | NY009-F1 | cgaaatctctcatcta agaggctggatcctag gATGGGTGTCACAGTC GTTAGCG (SEQ ID NO: 780) |
| PtIP-83Ga and PtIP-83Ga-like | NY009-R1 | taagttggccaatcca gaagatggacaagtct agaTTAGCTGACGACC TGATCATCGC (SEQ ID NO: 781) |
| PtIP-83Fg, Fi, and Fi-like | NY009-F2 | cgaaatctctcatcta agaggctggatcctag gATGGAGTATGGCAGC TTGTATGG (SEQ ID NO: 782) |
| PtIP-83Fg, Fi, and Fi-like | NY009-R2a | gttggccaatccagaa gatggacaagtctaga CTATAACTCCGCATCA GCTCGTTG (SEQ ID NO: 783) |
| PtIP-83Fh | NY009-F3 | cgaaatctctcatcta agaggctggatcctag gATGGAGTACTCCGAC TTGTATGAGG (SEQ ID NO: 784) |
| PtIP-83Fh | NY009-R3 | taagttggccaatcca gaagatggacaagtct agaTCACTCCTCATCG ACTTCCCG (SEQ ID NO: 785) |

Additional diversity was recovered by PCR amplification with primers designed to the non-coding regions flanking identified homologs. Primers were designed to conserved sequences in the 5' and 3' untranslated regions of PtIP-83Ca BLAST hits within the DUPONT PIONEER internal transcriptome database. Primers pairs (1) GCCTTTATC-GACTCCTAATTCACACC (SEQ ID NO: 626) and CCA-CATTGTGCATTACGACCAC (SEQ ID NO: 627), and (2) CCAGTGATTTGAGTTCCTTCATTATG (SEQ ID NO: 628) and GAACAGTACATTGACTGCATGTGC (SEQ ID NO: 629) were used to generate PCR products from PS-11481 and PS-12345 cDNA. Resulting PCR products were blunt end cloned using the Zero Blunt® TOPO® PCR Cloning Kit (Invitrogen) and sequence analyzed. From this analysis, homologs PtIP-83Cg, Da, Ea, and Eb were identified and subcloned into the plant transient vector. Cloning primers are shown in Table 8.

The amino acid sequence identity of the PtIP-83Aa homologs as calculated using the Needleman-Wunsch algorithm, as implemented in the Needle program (EMBOSS tool suite) are shown in Table 9a-9c.

TABLE 9a

| | PtIP-83Ca SEQ ID NO: 5 | PtIP-83Cb SEQ ID NO: 7 | PtIP-83Cc SEQ ID NO: 9 | PtIP-83Cd SEQ ID NO: 11 | PtIP-83Ce SEQ ID NO: 13 | PtIP-83Cf SEQ ID NO: 15 | PtIP-83Cg SEQ ID NO: 17 | PtIP-83Ch-like SEQ ID NO: 755 | PtIP-83Ch SEQ ID NO: 754 | PtIP-83Ci-like SEQ ID NO: 759 |
|---|---|---|---|---|---|---|---|---|---|---|
| PtIP-83Aa SEQ ID NO: 1 | 71.4 | 71.2 | 71.9 | 72.0 | 71.5 | 77.4 | 71.5 | 74.8 | 74.8 | 70.9 |
| PtIP-83Ca SEQ ID NO: 5 | — | 76.4 | 98.5 | 98.2 | 98.0 | 79.3 | 76.6 | 80.6 | 80.6 | 75.8 |
| PtIP-83Cb SEQ ID NO: 7 | — | — | 76.7 | 76.8 | 76.3 | 77.6 | 98.6 | 78.0 | 78.0 | 96.6 |
| PtIP-83Cc SEQ ID NO: 9 | — | — | — | 99.8 | 99.5 | 79.1 | 76.9 | 80.8 | 80.8 | 75.8 |
| PtIP-83Cd SEQ ID NO: 11 | — | — | — | — | 99.3 | 79.3 | 76.9 | 80.9 | 80.9 | 75.8 |
| PtIP-83Ce SEQ ID NO: 13 | — | — | — | — | — | 78.7 | 76.5 | 80.6 | 80.6 | 75.6 |
| PtIP-83Cf SEQ ID NO: 15 | — | — | — | — | — | — | 77.8 | 84.0 | 84.0 | 77.3 |
| PtIP-83Cg SEQ ID NO: 17 | — | — | — | — | — | — | — | 78.2 | 78.2 | 97.1 |
| PtIP-83Ch-like SEQ ID NO: 755 | — | — | — | — | — | — | — | — | 99.9 | 77.4 |
| PtIP-83Ch SEQ ID NO: 754 | — | — | — | — | — | — | — | — | — | 77.4 |
| PtIP-83Ci-like SEQ ID NO: 759 | — | — | — | — | — | — | — | — | — | — |
| PtIP-83Ci SEQ ID NO: 758 | — | — | — | — | — | — | — | — | — | — |
| PtIP-83Cj-like SEQ ID NO: 763 | — | — | — | — | — | — | — | — | — | — |
| PtIP-83Cj SEQ ID NO: 762 | — | — | — | — | — | — | — | — | — | — |
| PtIP-83Da SEQ ID NO: 19 | — | — | — | — | — | — | — | — | — | — |
| PtIP-83Ea SEQ ID NO: 21 | — | — | — | — | — | — | — | — | — | — |
| PtIP-83Eb SEQ ID NO: 23 | — | — | — | — | — | — | — | — | — | — |
| PtIP-83Fa SEQ ID NO: 3 | — | — | — | — | — | — | — | — | — | — |
| PtIP-83Fb SEQ ID NO: 716 | — | — | — | — | — | — | — | — | — | — |

TABLE 9a-continued

|  | PtIP-83Ca SEQ ID NO: 5 | PtIP-83Cb SEQ ID NO: 7 | PtIP-83Cc SEQ ID NO: 9 | PtIP-83Cd SEQ ID NO: 11 | PtIP-83Ce SEQ ID NO: 13 | PtIP-83Cf SEQ ID NO: 15 | PtIP-83Cg SEQ ID NO: 17 | PtIP-83Ch-like SEQ ID NO: 755 | PtIP-83Ch SEQ ID NO: 754 | PtIP-83Ci-like SEQ ID NO: 759 |
|---|---|---|---|---|---|---|---|---|---|---|
| PtIP-83Fd SEQ ID NO: 756 | — | — | — | — | — | — | — | — | — | — |
| PtIP-83Fe SEQ ID NO: 757 | — | — | — | — | — | — | — | — | — | — |
| PtIP-83Ff-like SEQ ID NO: 761 | — | — | — | — | — | — | — | — | — | — |
| PtIP-83Ff SEQ ID NO: 760 | — | — | — | — | — | — | — | — | — | — |
| PtIP-83Fg SEQ ID NO: 766 | — | — | — | — | — | — | — | — | — | — |
| PtIP-83Fh SEQ ID NO: 767 | — | — | — | — | — | — | — | — | — | — |
| PtIP-83Fi-like SEQ ID NO: 769 | — | — | — | — | — | — | — | — | — | — |
| PtIP-83Fi SEQ ID NO: 768 | — | — | — | — | — | — | — | — | — | — |
| PtIP-83Ga-like SEQ ID NO: 765 | — | — | — | — | — | — | — | — | — | — |

TABLE 9b

|  | PtIP-83Ci SEQ ID NO: 758 | PtIP-83Cj-like SEQ ID NO: 763 | PtIP-83Cj SEQ ID NO: 762 | PtIP-83Da SEQ ID NO: 19 | PtIP-83Ea SEQ ID NO: 21 | PtIP-83Eb SEQ ID NO: 23 | PtIP-83Fa SEQ ID NO: 3 | PtIP-83Fb SEQ ID NO: 716 | PtIP-83Fd SEQ ID NO: 756 |
|---|---|---|---|---|---|---|---|---|---|
| PtIP-83Aa SEQ ID NO: 1 | 71.0 | 75.5 | 73.6 | 64.7 | 55.8 | 55.4 | 49.8 | 50.1 | 50.8 |
| PtIP-83Ca SEQ ID NO: 5 | 75.9 | 79.5 | 77.5 | 89.7 | 68.6 | 79.1 | 48.8 | 48.3 | 48.8 |
| PtIP-83Cb SEQ ID NO: 7 | 96.7 | 79.5 | 77.2 | 68.8 | 59.3 | 60.2 | 49.7 | 49.3 | 50.4 |
| PtIP-83Cc SEQ ID NO: 9 | 76.0 | 79.8 | 77.8 | 91.1 | 70.1 | 80.4 | 49.2 | 48.7 | 49.1 |
| PtIP-83Cd SEQ ID NO: 11 | 76.0 | 79.9 | 77.9 | 90.8 | 70.1 | 80.2 | 49.2 | 48.7 | 49.2 |
| PtIP-83Ce SEQ ID NO: 13 | 75.7 | 79.8 | 77.8 | 90.7 | 70.5 | 80.9 | 49.3 | 48.8 | 48.9 |
| PtIP-83Cf SEQ ID NO: 15 | 77.4 | 87.1 | 84.8 | 71.4 | 60.5 | 61.8 | 49.3 | 48.9 | 52.8 |
| PtIP-83Cg SEQ ID NO: 17 | 97.2 | 79.6 | 77.4 | 69.1 | 59.3 | 60.4 | 49.5 | 49.4 | 50.5 |
| PtIP-83Ch-like SEQ ID NO: 755 | 77.6 | 84.9 | 82.6 | 72.5 | 62.5 | 62.9 | 50.6 | 50.6 | 52.5 |
| PtIP-83Ch SEQ ID NO: 754 | 77.6 | 84.9 | 82.6 | 72.5 | 62.5 | 62.9 | 50.6 | 50.7 | 52.5 |
| PtIP-83Ci-like SEQ ID NO: 759 | 99.9 | 79.0 | 76.8 | 68.1 | 58.9 | 59.9 | 49.9 | 49.8 | 49.3 |
| PtIP-83Ci SEQ ID NO: 758 | — | 79.1 | 76.9 | 68.2 | 59.1 | 59.9 | 50.1 | 49.9 | 49.4 |
| PtIP-83Cj-like SEQ ID NO: 763 | — | — | 97.0 | 71.7 | 61.1 | 62.7 | 50.7 | 50.7 | 51.5 |
| PtIP-83Cj SEQ ID NO: 762 | — | — | — | 69.7 | 61.6 | 60.7 | 50.3 | 50.3 | 50.4 |
| PtIP-83Da SEQ ID NO: 19 | — | — | — | — | 61.4 | 71.7 | 43.5 | 43.0 | 44.4 |
| PtIP-83Ea SEQ ID NO: 21 | — | — | — | — | — | 51.6 | 38.7 | 38.6 | 38.7 |
| PtIP-83Eb SEQ ID NO: 23 | — | — | — | — | — | — | 38.8 | 38.2 | 37.9 |
| PtIP-83Fa SEQ ID NO: 3 | — | — | — | — | — | — | — | 97.1 | 48.4 |
| PtIP-83Fb SEQ ID NO: 716 | — | — | — | — | — | — | — | — | 48.7 |
| PtIP-83Fd SEQ ID NO: 756 | — | — | — | — | — | — | — | — | — |
| PtIP-83Fe SEQ ID NO: 757 | — | — | — | — | — | — | — | — | — |
| PtIP-83Ff-like SEQ ID NO: 761 | — | — | — | — | — | — | — | — | — |
| PtIP-83Ff SEQ ID NO: 760 | — | — | — | — | — | — | — | — | — |
| PtIP-83Fg SEQ ID NO: 766 | — | — | — | — | — | — | — | — | — |

TABLE 9b-continued

|  | PtIP-83Ci SEQ ID NO: 758 | PtIP-83Cj-like SEQ ID NO: 763 | PtIP-83Cj SEQ ID NO: 762 | PtIP-83Da SEQ ID NO: 19 | PtIP-83Ea SEQ ID NO: 21 | PtIP-83Eb SEQ ID NO: 23 | PtIP-83Fa SEQ ID NO: 3 | PtIP-83Fb SEQ ID NO: 716 | PtIP-83Fd SEQ ID NO: 756 |
|---|---|---|---|---|---|---|---|---|---|
| PtIP-83Fh SEQ ID NO: 767 | — | — | — | — | — | — | — | — | — |
| PtIP-83Fi-like SEQ ID NO: 769 | — | — | — | — | — | — | — | — | — |
| PtIP-83Fi SEQ ID NO: 768 | — | — | — | — | — | — | — | — | — |
| PtIP-83Ga-like SEQ ID NO: 765 | — | — | — | — | — | — | — | — | — |

TABLE 9c

|  | PtIP-83Fe SEQ ID NO: 757 | PtIP-83Ff-like SEQ ID NO: 761 | PtIP-83Ff SEQ ID NO: 760 | PtIP-83Fg SEQ ID NO: 766 | PtIP-83Fh SEQ ID NO: 767 | PtIP-83Fi-like SEQ ID NO: 769 | PtIP-83Fi SEQ ID NO: 768 | PtIP-83Ga-like SEQ ID NO: 765 | PtIP-83Ga SEQ ID NO: 764 |
|---|---|---|---|---|---|---|---|---|---|
| PtIP-83Aa SEQ ID NO: 1 | 51.0 | 51.1 | 50.8 | 49.8 | 47.3 | 50.2 | 50.2 | 34.5 | 34.6 |
| PtIP-83Ca SEQ ID NO: 5 | 49.0 | 49.2 | 49.2 | 47.8 | 45.6 | 47.4 | 47.4 | 35.0 | 35.1 |
| PtIP-83Cb SEQ ID NO: 7 | 50.5 | 51.0 | 51.0 | 48.0 | 47.3 | 47.4 | 47.4 | 34.5 | 34.6 |
| PtIP-83Cc SEQ ID NO: 9 | 49.2 | 49.7 | 49.7 | 48.1 | 46.0 | 47.6 | 47.6 | 35.0 | 35.1 |
| PtIP-83Cd SEQ ID NO: 11 | 49.3 | 49.8 | 49.8 | 48.2 | 46.1 | 47.7 | 47.7 | 35.1 | 35.2 |
| PtIP-83Ce SEQ ID NO: 13 | 49.0 | 49.5 | 49.5 | 48.2 | 46.0 | 47.7 | 47.7 | 35.0 | 35.1 |
| PtIP-83Cf SEQ ID NO: 15 | 52.5 | 51.5 | 51.5 | 49.7 | 48.3 | 49.3 | 49.3 | 35.5 | 35.6 |
| PtIP-83Cg SEQ ID NO: 17 | 50.7 | 50.4 | 50.4 | 47.8 | 46.9 | 47.2 | 47.2 | 34.5 | 34.6 |
| PtIP-83Ch-like SEQ ID NO: 755 | 52.4 | 51.5 | 51.6 | 49.7 | 48.4 | 49.4 | 49.4 | 34.6 | 34.7 |
| PtIP-83Ch SEQ ID NO: 754 | 52.4 | 51.5 | 51.6 | 49.7 | 48.1 | 49.7 | 49.7 | 34.7 | 34.8 |
| PtIP-83Ci-like SEQ ID NO: 759 | 49.9 | 50.9 | 50.5 | 47.9 | 47.0 | 47.6 | 47.6 | 34.6 | 34.7 |
| PtIP-83Ci SEQ ID NO: 758 | 50.1 | 51.0 | 50.7 | 48.0 | 47.1 | 47.7 | 47.7 | 34.5 | 34.6 |
| PtIP-83Cj-like SEQ ID NO: 763 | 51.5 | 51.5 | 51.5 | 49.3 | 46.7 | 49.2 | 49.2 | 35.2 | 35.3 |
| PtIP-83Cj SEQ ID NO: 762 | 50.4 | 50.2 | 50.2 | 48.9 | 46.1 | 48.8 | 48.8 | 34.8 | 34.9 |
| PtIP-83Da SEQ ID NO: 19 | 44.6 | 44.6 | 44.6 | 42.5 | 40.5 | 42.0 | 42.0 | 30.5 | 30.6 |
| PtIP-83Ea SEQ ID NO: 21 | 38.6 | 38.7 | 38.7 | 39.6 | 36.9 | 39.3 | 39.3 | 29.0 | 29.1 |
| PtIP-83Eb SEQ ID NO: 23 | 38.1 | 38.7 | 38.7 | 36.6 | 36.1 | 36.4 | 36.4 | 27.4 | 27.5 |
| PtIP-83Fa SEQ ID NO: 3 | 48.3 | 48.9 | 49.5 | 73.4 | 64.6 | 71.9 | 71.9 | 31.8 | 31.9 |
| PtIP-83Fb SEQ ID NO: 716 | 48.8 | 48.9 | 48.9 | 73.0 | 64.3 | 71.8 | 71.8 | 31.9 | 32.0 |
| PtIP-83Fd SEQ ID NO: 756 | 96.5 | 72.9 | 73.0 | 49.9 | 47.7 | 49.2 | 49.3 | 33.8 | 33.7 |
| PtIP-83Fe SEQ ID NO: 757 | — | 72.9 | 73.0 | 50.0 | 47.7 | 49.2 | 49.3 | 33.5 | 33.4 |
| PtIP-83Ff-like SEQ ID NO: 761 | — | — | 99.9 | 49.1 | 46.5 | 48.4 | 48.5 | 33.1 | 33.1 |
| PtIP-83Ff SEQ ID NO: 760 | — | — | — | 49.1 | 46.5 | 48.4 | 48.5 | 33.2 | 33.2 |
| PtIP-83Fg SEQ ID NO: 766 | — | — | — | — | 66.4 | 94.8 | 94.9 | 31.8 | 31.9 |
| PtIP-83Fh SEQ ID NO: 767 | — | — | — | — | — | 65.3 | 65.4 | 31.1 | 31.1 |
| PtIP-83Fi-like SEQ ID NO: 769 | — | — | — | — | — | — | 99.9 | 32.1 | 32.2 |
| PtIP-83Fi SEQ ID NO: 768 | — | — | — | — | — | — | — | 32.2 | 32.3 |
| PtIP-83Ga-like SEQ ID NO: 765 | — | — | — | — | — | — | — | — | 99.9 |

Example 4: Transient Expression in Leaves and Insect Bioassay

To confirm activity of PtIP-83Aa (SEQ ID NO: 1) a transient expression system under control of a viral promoter pDMMV and/or AtUBQ10 (Dav, et. al., (1999) *Plant Mol. Biol.* 40:771-782; Norris S R et al (1993) *Plant Mol Biol.* 21(5):895-906) was utilized. The agro-infiltration method of introducing an *Agrobacterium* cell suspension to plant cells of intact tissues so that reproducible infection and subsequent plant derived transgene expression may be measured or studied is well known in the art (Kapila, et. al., (1997) *Plant Science* 122:101-108). Briefly, the unifoliate stage of bush bean (common bean, *Phaseolus vulgaris*) or soybean (*Glycine max*), were agro-infiltrated with normalized bacterial cell cultures of test and control strains. After 4 to 7 days leaf disks were excised from each plantlet and infested with 2 neonates of Soybean Looper (SBL) (*Chrysodeixis includens*), 2 neonates of Corn Earworm (CEW) (*Helicoverpa zea*), 2 neonates of Fall Armyworm (*Spodoptera frugiperda*) or 4 neonates of European Corn Borer (ECB) (*Ostrinia nubilalis*) alone. Control leaf discs were generated with *Agrobacterium* containing only a DsRed2 fluorescence marker (Clontech™, 1290 Terra Bella Ave. Mountain View, Calif. 94043) expression vector. Leaf discs from non-infiltrated plants were included as a second control. The consumption of green leaf tissue was scored two (CEW, FAW) or three (ECB, SBL, FAW) days after infestation and given scores of 0 to 9. The transiently expressed PtIP-83Aa (SEQ ID NO: 1), protected leaf discs from consumption by the infested insects while total green tissue consumption was observed for the negative control and untreated tissue (Table 10). Transient protein expression of PtIP-83Aa (SEQ ID NO: 1) was confirmed by mass spectrometry-based protein identification using trypsinized protein extracts of infiltrated leaf tissues (Patterson, (1998) 10(22):1-24, Current Protocol in Molecular Biology published by John Wiley & Son Inc). Transient expression can be verified by using HA or EPEA tagged PtIP-83 polypeptides by western analysis of the HA or EPEA tags.

TABLE 10

| Transient expression | Leaf Disc Consumption (Scale 1 to 9) | | | |
|---|---|---|---|---|
| | FAW | CEW | SBL | ECB |
| PtIP-83Aa | 8.3 | 8.3 | 8.6 | 8.9 |

| Value | Description |
|---|---|
| 1 | leaf disk is greater than 90% consumed |
| 2 | leaf disk is 70-80% consumed |
| 3 | leaf disk is 60-70% consumed |
| 4 | leaf disk is 50-60% consumed |
| 5 | leaf disk is 40-50% consumed |
| 6 | leaf disk is less than 30% consumed |
| 7 | leaf disk is less than 10% consumed |
| 8 | leaf disk has only a few pinholes |
| 9 | leaf disk is untouched by the insect |

Activity of PtIP-83Fa (SEQ ID NO: 4) was validated using the bush bean transient expression system and found to be comparable to PtIP-83Aa (SEQ ID NO: 2). PtIP-83Fa (SEQ ID NO: 4) showed a similar insecticidal activity spectrum except for lacking activity against FAW (Table 11).

TABLE 11

| Transient experiment | Leaf Disc Consumption (Scale 1 to 9) | | | |
|---|---|---|---|---|
| | FAW | CEW | SBL | ECB |
| PtIP-83Fa | 1.0 | 6.8 | 8.1 | 7.4 |
| Vector control | 1.7 | 2.3 | 1.1 | 1.8 |
| blank | 1.0 | 1.1 | 1.4 | 1.0 |

Activity of PtIP-83Ca (SEQ ID NO: 5), PtIP-83Cb (SEQ ID NO: 7), PtIP-83Cc (SEQ ID NO: 9), PtIP-83Cd (SEQ ID NO: 11), PtIP-83Ce (SEQ ID NO: 13), PtIP-83Cf (SEQ ID NO: 15), PtIP-83Cg (SEQ ID NO: 17), PtIP-83 Da (SEQ ID NO: 19), PtIP-83Ea (SEQ ID NO: 21), PtIP-83Eb (SEQ ID NO: 23), PtIP-83Fb (SEQ ID NO: 716), PtIP-83Ch (SEQ ID NO: 754), PtIP-83Ch-like (SEQ ID NO: 755), PtIP-83Fd (SEQ ID NO: 756), PtIP-83Fe (SEQ ID NO: 757), PtIP-83Ci (SEQ ID NO: 758), PtIP-83Ci-like (SEQ ID NO: 759), PtIP-83Ff (SEQ ID NO: 760), and PtIP-83Ff-like (SEQ ID NO: 761) were also validated using a bush bean transient expression system. The activity spectra for all PtIP-83 homologs are summarized in Table 12, where a "+" indicates an average activity score of <=60% of leaf disc consumed, and a "−" indicates an average activity score of. >=60% leaf disc consumed.

TABLE 12

| | FAW | CEW | SBL | ECB |
|---|---|---|---|---|
| PtIP-83Aa | + | + | + | + |
| PtIP-83Ca | − | + | + | + |
| PtIP-83Cb | + | + | + | − |
| PtIP-83Cc | + | + | + | + |
| PtIP-83Cd | + | + | + | + |
| PtIP-83Ce | − | + | + | + |
| PtIP-83Cf | − | − | + | − |
| PtIP-83Cg | + | + | + | + |
| PtIP-83Da | − | − | − | − |
| PtIP-83Ea | − | − | − | + |
| PtIP-83Eb | − | − | − | − |
| PtIP-83Fa | − | + | + | + |
| PtIP-83Fb | | + | + | + |
| PtIP-83Ch | − | − | − | + |
| PtIP-83Ch-like | − | − | − | + |
| PtIP-83Fd | − | − | + | − |
| PtIP-83Fe | − | − | − | − |
| PtIP-83Ci | + | + | + | + |
| PtIP-83Ci-like | + | + | + | + |
| PtIP-83Ff | − | − | − | − |
| PtIP-83Ff-like | + | − | + | + |
| PtIP-83Cj | not tested | | | |
| PtIP-83Cj-like | not tested | | | |
| PtIP-83Ga | not tested | | | |
| PtIP-83Ga-like | not tested | | | |
| PtIP-83Fg | not tested | | | |
| PtIP-83Fh | not tested | | | |
| PtIP-83Fi | not tested | | | |
| PtIP-83Fi-like | not tested | | | |

Example 5: Baculovirus Expression of PtIP-83Aa Polypeptides

The gene encoding PtIP-83Aa SEQ ID NO: 2 was subcloned into the pFastBac™ Dual vector (Invitrogen®) with the stop codon removed for C-terminal translation of a 10x-histidine tag addition (SEQ ID NO: 27) and the sequence of the histidine-tagged PtIP-83Aa polypeptide is set forth as SEQ ID NO: 2. This vector was transformed into DH10Bac cells to generate baculovirus. These baculovirus were used to infect sf9 insect cells and incubated for 72 hours at 27° C. The infected insect cells were harvested by centrifugation. The cell culture pellet was suspended with 100 mL of lysis buffer (1×PBS, 10% glycerol, with protease inhibitor and benzonase) and incubated at 4° C. for 5 min with stirring, then homogenizing twice. The lysate was centrifuged at 16000 rpm for 20 min. The supernatant was saved and loaded onto two 2 mL Ni-NTA Hi-Bind Resin (Novagen, cat#70666) columns pre-equilibrated with Elute buffer (1×PBS, 10% glycerol). The columns were then sequentially eluted with 10 mL of Elute buffer containing 10, 20, 50, and 250 mM of imidazole. Samples were analyzed by SDS-PAGE. The purified fractions (E250) were concentrated using 100K Amicon® Ultra Centrifugal Filters (Millipore) to ~0.5 mg/mL and demonstrated insecticidal activity against CEW, ECB, FAW and SBL similar to the activity spectrum obtained using transient expressing leaf discs.

Example 6: *Agrobacterium*-Mediated Transformation of Maize and Regeneration of Transgenic Plants For *Agrobacterium*-mediated transformation of maize with PtIP-83 nucleotide sequences such as PtIP-83Aa (SEQ ID NO: 2), PtIP-83Aa ModA (codon optimized) (SEQ ID NO: 28), and PtIP-83Aa ModB (codon optimized (SEQ ID NO: 29), the method of Zhao can be used (U.S. Pat. No. 5,981,840 and PCT Patent Publication Number WO 1998/32326; the contents of which are hereby incorporated by reference). Briefly, immature embryos were isolated from maize and the embryos contacted with a suspension of *Agrobacterium* under conditions whereby the bacteria are capable of transferring the nucleotide sequence (PtIP-83Aa SEQ ID NO: 2, PtIP-83Aa ModA (codon optimized)—SEQ ID NO: 28, and PtIP-83Aa ModB (codon optimized—SEQ ID NO: 29) to at least one cell of at least one of the immature embryos (step 1: the infection step). In this step the immature embryos can be immersed in an *Agrobacterium* suspension for the initiation of inoculation. The embryos were co-cultured for a time with the *Agrobacterium* (step 2: the co-cultivation step). The immature embryos can be cultured on solid medium following the infection step. Following this co-cultivation period an optional "resting" step is contemplated. In this resting step, the embryos were incubated in the presence of at least one antibiotic known to inhibit the growth of *Agrobacterium* without the addition of a selective agent for plant transformation (step 3: resting step). The immature embryos were cultured on solid medium with antibiotic, but without a selecting agent, for elimination of *Agrobacterium* and for a resting phase for the infected cells. Next, inoculated embryos were cultured on medium containing a selective agent and growing transformed callus is recovered (step 4: the selection step). The immature embryos were cultured on solid medium with a selective agent resulting in the selective growth of transformed cells. The callus was then regenerated into plants (step 5: the regeneration step), and calli grown on selective medium were cultured on solid medium to regenerate the plants.

Example 7: Transformation and Regeneration of Soybean (*Glycine max*)

Transgenic soybean lines are generated by the method of particle gun bombardment (Klein et al., *Nature* (London) 327:70-73 (1987); U.S. Pat. No. 4,945,050) using a BIO-RAD Biolistic PDS1000/He instrument and either plasmid or fragment DNA. The following stock solutions and media are used for transformation and regeneration of soybean plants:

Stock Solutions:
Sulfate 100× Stock:
  37.0 g MgSO$_4$.7H$_2$O, 1.69 g MnSO$_4$.H$_2$O, 0.86 g ZnSO$_4$.7H$_2$O, 0.0025 g CuSO$_4$.5H$_2$O
Halides 100× Stock:
  30.0 g CaCl$_2$.2H$_2$O, 0.083 g KI, 0.0025 g CoCl$_2$.6H$_2$O
P, B, Mo 100× Stock:
  18.5 g KH$_2$PO$_4$, 0.62 g H$_3$BO$_3$, 0.025 g Na$_2$MoO$_4$.2H$_2$O
Fe EDTA 100× Stock:
  3.724 g Na$_2$EDTA, 2.784 g FeSO$_4$.7H$_2$O
2,4-D Stock:
  10 mg/mL Vitamin
B5 vitamins, 1000× Stock:
  100.0 g myo-inositol, 1.0 g nicotinic acid, 1.0 g pyridoxine HCl, 10 g thiamine.HCL.

Media (Per Liter):
SB199 Solid Medium:
  1 package MS salts (Gibco/BRL—Cat. No. 11117-066), 1 mL B5 vitamins 1000× stock, 30 g Sucrose, 4 ml 2, 4-D (40 mg/L final concentration), pH 7.0, 2 gm Gelrite
SB1 Solid Medium:
  1 package MS salts (Gibco/BRL—Cat. No. 11117-066), 1 mL B5 vitamins 1000× stock, 31.5 g Glucose, 2 mL 2, 4-D (20 mg/L final concentration), pH 5.7, 8 g TC agar
SB196:
  10 mL of each of the above stock solutions 1-4, 1 mL B5 Vitamin stock, 0.463 g (NH4)2 SO4, 2.83 g KNO3, 1 mL 2.4 D stock, 1 g asparagine, 10 g Sucrose, pH 5.7
SB71-4:
  Gamborg's B5 salts, 20 g sucrose, 5 g TC agar, pH 5.7.
SB103:
  1 pk. Murashige & Skoog salts mixture, 1 mL B5 Vitamin stock, 750 mg MgCl2 hexahydrate, 60 g maltose, 2 g Gelrite™, pH 5.7.
SB166:
  SB103 supplemented with 5 g per liter activated charcoal.

Soybean Embryogenic Suspension Culture Initiation:
  Pods with immature seeds from available soybean plants 45-55 days after planting are picked, removed from their shells and placed into a sterilized magenta box. The soybean seeds are sterilized by shaking them for 15 min in a 5% Clorox® solution with 1 drop of Ivory™ soap (i.e., 95 mL of autoclaved distilled water plus 5 mL Clorox® and 1 drop of soap, mixed well). Seeds are rinsed using 2 L sterile distilled water and those less than 3 mm are placed on individual microscope slides. The small end of the seed is cut and the cotyledons pressed out of the seed coat. Cotyledons are transferred to plates containing SB199 medium (25-30 cotyledons per plate) for 2 weeks, then transferred to SB1 for 2-4 weeks. Plates are wrapped with fiber tape. After this time, secondary embryos are cut and placed into SB196 liquid medium for 7 days.

Culture Conditions:
  Soy bean embryogenic suspension cultures (cv. 93Y21) were maintained in 50 mL liquid medium SB196 on a rotary shaker, 100-150 rpm, 26° C. on 16:8 h day/night photoperiod at light intensity of 80-100 μE/m2/s. Cultures are subcultured every 7-14 days by inoculating up to ½ dime size quantity of tissue (clumps bulked together) into 50 mL of fresh liquid SB196.

Preparation of DNA for Bombardment:
  In particle gun bombardment procedures it is possible to use purified 1) entire plasmid DNA; or 2) DNA fragments containing only the recombinant DNA expression cassette(s)

of interest. For every seventeen bombardment transformations, 85 µL of suspension is prepared containing 1 to 90 picograms (pg) of plasmid DNA per base pair of each DNA plasmid. DNA plasmids or fragments are co-precipitated onto gold particles as follows. The DNAs in suspension are added to 50 µL of a 10-60 mg/mL 0.6 µm gold particle suspension and then combined with 50 µL $CaCl_2$ (2.5 M) and 20 µL spermidine (0.1 M). The mixture is vortexed for 5 sec, spun in a microfuge for 5 sec, and the supernatant removed. The DNA-coated particles are then washed once with 150 µL of 100% ethanol, vortexed and spun in a microfuge again, then resuspended in 85 µL of anhydrous ethanol. Five µL of the DNA-coated gold particles are then loaded on each macrocarrier disc.

Tissue Preparation and Bombardment with DNA:

Approximately 100 mg of two-week-old suspension culture is placed in an empty 60 mm×15 mm petri plate and the residual liquid removed from the tissue using a pipette. The tissue is placed about 3.5 inches away from the retaining screen and each plate of tissue is bombarded once. Membrane rupture pressure is set at 650 psi and the chamber is evacuated to −28 inches of Hg. Following bombardment, the tissue from each plate is divided between two flasks, placed back into liquid media, and cultured as described above.

Selection of Transformed Embryos and Plant Regeneration:

After bombardment, tissue from each bombarded plate is divided and placed into two flasks of SB196 liquid culture maintenance medium per plate of bombarded tissue. Seven days post bombardment, the liquid medium in each flask is replaced with fresh SB196 culture maintenance medium supplemented with 100 ng/ml selective agent (selection medium). For selection of transformed soybean cells the selective agent used can be a sulfonylurea (SU) compound with the chemical name, 2-chloro-N-((4-methoxy-6 methy-1,3,5-triazine-2-yl)aminocarbonyl) benzenesulfonamide (common names: DPX-W4189 and chlorsulfuron). Chlorsulfuron is the active ingredient in the DuPont sulfonylurea herbicide, GLEAN®. The selection medium containing SU is replaced every two weeks for 8 weeks. After the 8 week selection period, islands of green, transformed tissue are observed growing from untransformed, necrotic embryogenic clusters. These putative transgenic events are isolated and kept in SB196 liquid medium with SU at 100 ng/ml for another 5 weeks with media changes every 1-2 weeks to generate new, clonally propagated, transformed embryogenic suspension cultures. Embryos spend a total of around 13 weeks in contact with SU. Suspension cultures are subcultured and maintained as clusters of immature embryos and also regenerated into whole plants by maturation and germination of individual somatic embryos.

Somatic embryos became suitable for germination after four weeks on maturation medium (1 week on SB166 followed by 3 weeks on SB103). They are then removed from the maturation medium and dried in empty petri dishes for up to seven days. The dried embryos are then planted in SB71-4 medium where they are allowed to germinate under the same light and temperature conditions as described above. Germinated embryos are transferred to potting medium and grown to maturity for seed production.

Example 8—Particle Bombardment Transformation and Regeneration of Transgenic Plants Immature maize embryos from greenhouse donor plants are bombarded with a plasmid containing a nucleotide sequence encoding the insecticidal protein. The ears are husked and surface sterilized in 30% Clorox® bleach plus 0.5% Micro detergent for 20 minutes and rinsed two times with sterile water. The immature embryos are excised and placed embryo axis side down (scutellum side up), 25 embryos per plate, on 560Y medium for 4 hours and then aligned within the 2.5 cm target zone in preparation for bombardment. A plasmid vector DNA comprising the nucleotide sequence encoding the insecticidal protein operably linked to a promoter is precipitated onto 1.1 µm (average diameter) tungsten pellets using a $CaCl_2$ precipitation procedure as follows: 100 µl prepared tungsten particles in water; 10 µl (1 µg) DNA in Tris EDTA buffer (1 µg total DNA); 100 µl 2.5 M $CaCl_2$ and 10 µl 0.1 M spermidine.

Each reagent is added sequentially to the tungsten particle suspension, while maintained on the multitube vortexer. The final mixture is sonicated briefly and allowed to incubate under constant vortexing for 10 minutes. After the precipitation period, the tubes are centrifuged briefly, liquid removed, washed with 500 ml 100% ethanol and centrifuged for 30 seconds. Again the liquid is removed, and 105 µl 100% ethanol is added to the final tungsten particle pellet. For particle gun bombardment, the tungsten/DNA particles are briefly sonicated and 10 µl spotted onto the center of each macrocarrier and allowed to dry about 2 minutes before bombardment. The sample plates are bombarded at level #4 in a particle gun. All samples receive a single shot at 650 PSI, with a total of ten aliquots taken from each tube of prepared particles/DNA Following bombardment, the embryos are kept on 560Y medium for 2 days, then transferred to 560R selection medium containing 3 mg/liter Bialaphos, and subcultured every 2 weeks. After approximately 10 weeks of selection, selection-resistant callus clones are transferred to 288J medium to initiate plant regeneration. Following somatic embryo maturation (2-4 weeks), well-developed somatic embryos are transferred to medium for germination and transferred to the lighted culture room. Approximately 7-10 days later, developing plantlets are transferred to 272V hormone-free medium in tubes for 7-10 days until plantlets are well established. Plants are then transferred to inserts in flats (equivalent to 2.5" pot) containing potting soil and grown for 1 week in a growth chamber, subsequently grown an additional 1-2 weeks in the greenhouse, then transferred to classic 600 pots (1.6 gallon) and grown to maturity. Plants are monitored and scored for expression of a PtIP-83 polypeptide by assays known in the art, such as, for example, immunoassays and Western blotting.

Transgenic maize plants positive for expression of the insecticidal proteins are tested for pesticidal activity using standard bioassays known in the art. Such methods include, for example, root excision bioassays and whole plant bioassays. See, e.g., US Patent Application Publication Number US 2003/0120054 and International Publication Number WO 2003/018810.

Bombardment medium (560Y) comprises 4.0 g/l N6 basal salts (SIGMA C-1416), 1.0 ml/l Eriksson's Vitamin Mix (1000.times.SIGMA-1511), 0.5 mg/l thiamine HCl, 120.0 g/l sucrose, 1.0 mg/l 2,4-D and 2.88 g/l L-proline (brought to volume with D-I $H_2O$ following adjustment to pH 5.8 with KOH); 2.0 g/l Gelrite (added after bringing to volume with D-I $H_2O$) and 8.5 mg/l silver nitrate (added after sterilizing the medium and cooling to room temperature). Selection medium (560R) comprises 4.0 g/l N6 basal salts (SIGMA C-1416), 1.0 ml/l Eriksson's Vitamin Mix (1000.times.SIGMA-1511), 0.5 mg/l thiamine HCl, 30.0 g/l sucrose and 2.0 mg/l 2,4-D (brought to volume with D-I $H_2O$ following adjustment to pH 5.8 with KOH); 3.0 g/l Gelrite (added after bringing to volume with D-I $H_2O$) and 0.85 mg/l silver nitrate and 3.0 mg/l bialaphos (both added after sterilizing the medium and cooling to room temperature).

Plant regeneration medium (288J) comprises 4.3 g/l MS salts (GIBCO 11117-074), 5.0 ml/l MS vitamins stock solution (0.100 g nicotinic acid, 0.02 g/l thiamine HCL, 0.10

NO: 1) and PtIP50Aa (SEQ ID NO: 34) were generated by multi-PCR fragments overlap assembly (Gibson Assembly Cloning Kit, New England Biolabs Inc.). A total of 6 chimeras were constructed: Table 13 shows the crossover points and the % sequence identity to PtIP-83Aa (SEQ ID NO: 1).

TABLE 13

| Chimera Designation | polynucleotide | Beginning crossover | Ending crossover | % Seq. iden. to PtIP-83Aa | Soybean looper active |
|---|---|---|---|---|---|
| Chimera 1 SEQ ID NO: 640 | SEQ ID NO: 634 | Q334 | S473 | 94 | No |
| Chimera 2 SEQ ID NO: 641 | SEQ ID NO: 635 | G469 | N615 | 95 | No |
| Chimera 3 SEQ ID NO: 642 | SEQ ID NO: 636 | P610 | E713 | 95 | Yes |
| Chimera 4 SEQ ID NO: 643 | SEQ ID NO: 637 | P754 | E873 | 94 | No |
| Chimera 5 SEQ ID NO: 644 | SEQ ID NO: 638 | F823 | E873 | 98 | Yes |
| Chimera 6 SEQ ID NO: 645 | SEQ ID NO: 639 | Q334 | E713 | 85 | No |

Crossover position numbers are based on the alignment shown in FIG. 3 g/l pyridoxine HCL, and 0.40 g/l glycine brought to volume with polished D-I H$_2$O) (Murashige and Skoog, (1962) Physiol. Plant. 15:473), 100 mg/l myo-inositol, 0.5 mg/l zeatin, 60 g/l sucrose and 1.0 ml/l of 0.1 mM abscisic acid (brought to volume with polished D-I H$_2$O after adjusting to pH 5.6); 3.0 g/l Gelrite (added after bringing to volume with D-I H$_2$O) and 1.0 mg/l indoleacetic acid and 3.0 mg/l bialaphos (added after sterilizing the medium and cooling to 60° C.). Hormone-free medium (272V) comprises 4.3 g/l MS salts (GIBCO 11117-074), 5.0 ml/l MS vitamins stock solution (0.100 g/l nicotinic acid, 0.02 g/l thiamine HCL, 0.10 g/l pyridoxine HCL and 0.40 g/l glycine brought to volume with polished D-I H$_2$O), 0.1 g/l myo-inositol and 40.0 g/l sucrose (brought to volume with polished D-I H$_2$O after adjusting pH to 5.6) and 6 g/l bacto-agar (added after bringing to volume with polished D-I H$_2$O), sterilized and cooled to 60° C.

Example 9. Insect Control Efficacy of Stable Transformed Soybean and Corn Plants Against Broad Spectrum of Lepidopteran Insects Leaf discs are excised from the transformed plants and tested for insecticidal activity of PtIP-83 polypeptides against the Soy Bean Looper (SBL) (*Chrysodeixis includens*), Corn Earworm, (CEW) (*Helicoverpa zea*), European Corn Borer (ECB) (*Ostrinia nubilalis*), Velvet Bean Caterpillar (VBC) (*Anticarsia gemmatalis*) and Fall Armyworm (*Spodoptera frugiperda*).

Example 10. Chimeras Between PtIP-83Aa (SEQ ID NO: 1) and PtIP-50Aa (SEQ ID NO: 34)

To generate single component active variants with diversified sequences, chimeras between PtIP-83Aa (SEQ ID The chimera genes were cloned into a plant transient expression vector and SBL activity assays were performed as described in Example 4.

Example 11—Identification of Motifs Affecting the Protein Function of PtIP-83Aa

To identify sequence space affecting protein structural stability and insecticidal function of PtIP-83Aa, five unique motifs were identified by amino acid alignment among PtIP-83Aa, PtIP-50Aa (SEQ ID NO: 34), PtIP-50Ba (SEQ ID NO: 35), PtIP-50Bb (SEQ ID NO: 36), and PtIP-83Fa (SEQ ID NO: 3) (FIG. 4a-4d). Three conserved motifs: amino acids V53-P66 of SEQ ID NO: 1 were defined as Motif A, amino acids Q363-N373 of SEQ ID NO: 1 as Motif B and amino acids W556-A564 of SEQ ID NO: 1 as Motif C. Another two variable motifs were also picked: amino acids L646-W655 of SEQ ID NO: 1 as Motif D and amino acids R771-Y786 of SEQ ID NO: 1 as Motif E. Saturation mutagenesis primers were designed for these five motifs as shown in Table 14, Table 15, Table 16, Table 17 and Table 18. Saturation mutagenesis was performed using Agilent's QuikChange® Lightning Site-Directed Mutagenesis Kit. Mutations were introduced by amplifying a plant expression vector containing the polynucleotide of SEQ ID NO: 2 encoding the PtIP-83Aa polypeptide (SEQ ID NO: 1) using complementing forward and reverse primers containing a NNK degenerate codon at the targeted position. Amino acid substitutions at each targeted position were identified by DNA sequencing. Plant transient expression and SBL activity assays were performed as described in example 4. The amino acid substitutions identified in Motif A, Motif B, Motif C, Motif D, and Motif E of PtIP-83Aa (SEQ ID NO: 1) and the amino acid substitutions with insecticidal activity are shown in Table 14, Table 15, Table 16, Table 17 and Table 18 respectively.

TABLE 14

| Position | Oligo name | Primer | Identified substitutions | Active substitutions† |
|---|---|---|---|---|
| V53 | 083SM-V53-F | SEQ ID NO: 38 | A, C, D, E, F, G, H, K, L, N, P, Q, R, S, T, Y | A, C, T |
| K54 | 083SM-K54-F | SEQ ID NO: 39 | A, C, D, E, F, G, H, I, L, M, N, P, Q, R, S, T, V, W, Y | A, C, D, E, G, H, I, L, M, N, Q, R, S, T |
|  | 083SM-K54-R | SEQ ID NO: 40 |  |  |
| R55 | 083SM-R55-F | SEQ ID NO: 41 | A, D, E, F, G, H, K, L, M, N, P, Q, S, T, V, W, Y | A, D, E, F, G, H, K, L, M, N, Q, S, T, V, W, Y |
|  | 083SM-R55-R | SEQ ID NO: 42 |  |  |
| L56 | 083SM-L56-F | SEQ ID NO: 43 | A, D, E, F, G, I, M, N, P, Q, R, S, T, V, W, Y | E, F, I, M, T, V |
|  | 083SM-L56-R | SEQ ID NO: 44 |  |  |
| Y57 | 083SM-Y57-F | SEQ ID NO: 45 | A, C, D, E, G, H, I, K, L, M, N, P, Q, R, S, T, V | C, I, L, M, T, V |
|  | 083SM-Y57-R | SEQ ID NO: 46 |  |  |
| V58 | 083SM-V58-F | SEQ ID NO: 47 | A, C, D, F, G, H, I, K, L, N, P, Q, R, S, T, W, Y | C, I, L |
|  | 083SM-V58-R | SEQ ID NO: 48 |  |  |
| F59 | 083SM-F59-F | SEQ ID NO: 49 | A, C, D, E, G, H, I, K, L, M, N, P, Q, R, S, T, V, Y | L, M, V, Y |
|  | 083SM-F59-R | SEQ ID NO: 50 |  |  |
| A60 | 083SM-A60-F | SEQ ID NO: 51 | C, D, E, F, G, H, I, L, M, N, P, Q, R, S, T, V, Y | C, G, S, T, V |
|  | 083SM-A60-R | SEQ ID NO: 52 |  |  |
| D61 | 083SM-D61-F | SEQ ID NO: 53 | C, E, F, G, H, I, K, L, N, P, Q, R, S, T, V, W, Y | E, H, S |
|  | 083SM-D61-R | SEQ ID NO: 54 |  |  |
| V62 | 083SM-V62-F | SEQ ID NO: 55 | A, C, D, E, F, G, H, I, K, L, M, N, P, R, S, T, Y | A, C, I, L, T |
|  | 083SM-V62-R | SEQ ID NO: 56 |  |  |
| V63 | 083SM-V63-F | SEQ ID NO: 57 | A, C, G, H, I, K, L, M, N, P, Q, R, S, T, W, Y | A, C, I, L, M, T |
|  | 083SM-V63-R | SEQ ID NO: 58 |  |  |
| E64 | 083SM-E64-F | SEQ ID NO: 59 | A, C, F, G, H, I, L, M, N, P, Q, R, S, T, V, W, Y | A, C, F, G, H, I, L, M, N, Q, R, S, T, V, W, Y |
|  | 083SM-E64-R | SEQ ID NO: 60 |  |  |
| L65 | 083SM-L65-F | SEQ ID NO: 61 | A, C, D, F, G, H, I, M, N, P, Q, R, S, T, V, W, Y | A, C, F, H, I, M, N, Q, T, V, W |
|  | 083SM-L65-R | SEQ ID NO: 62 |  |  |
| P66 | 083SM-P66-F | SEQ ID NO: 63 | A, C, D, E, F, G, I, K, L, M, N, Q, R, S, T, V, W, Y | D, G, M, Q, R |
|  | 083SM-P66-R | SEQ ID NO: 64 |  |  |

†Active substitutions: average activity score <=60% of leaf disk eaten

TABLE 15

| Position | Oligo name | Primer sequence | Identified substitutions | Active substitutions |
|---|---|---|---|---|
| Q363 | 083SM-Q363-F | SEQ ID NO: 65 | A, C, E, F, G, H, K, L, N, P, R, S, T, V, W | A, C, E, F, G, H, K, L, N, R, S, T, V, W |
|  | 083SM-Q363-R | SEQ ID NO: 66 |  |  |
| I364 | 083SM-I364-F | SEQ ID NO: 67 | A, C, D, E, F, G, H, K, L, M, N, P, Q, R, S, T, V, W, Y | A, C, E, F, H, K, L, M, N, Q, S, T, V, W, Y |
|  | 083SM-I364-R | SEQ ID NO: 68 |  |  |
| L365 | 083SM-L365-F | SEQ ID NO: 69 | A, E, F, G, H, I, K, M, N, P, R, S, T, V, W, Y | A, E, F, G, H, I, K, M, N, R, V, W, Y |
|  | 083SM-L365-R | SEQ ID NO: 70 |  |  |
| G366 | 083SM-G366-F | SEQ ID NO: 71 | A, C, E, F, H, I, K, L, M, N, P, R, S, T, V, W | A, C, F, H, I, K, L, M, N, S, T, V |
|  | 083SM-G366-R | SEQ ID NO: 72 |  |  |
| S367 | 083SM-S367-F | SEQ ID NO: 73 | A, C, D, E, F, G, H, I, L, M, N, P, Q, R, T, V, W | A, C, D, E, F, G, H, I, L, M, N, P, Q, R, T, V, W |
|  | 083SM-S367-R | SEQ ID NO: 74 |  |  |
| Y368 | 083SM-Y368-F | SEQ ID NO: 75 | A, C, D, E, F, G, H, I, K, L, M, N, P, Q, R, S, T, V, W | A, C, D, E, F, G, H, I, K, L, M, N, P, Q, R, S, T, V, W |
|  | 083SM-Y368-R | SEQ ID NO: 76 |  |  |
| L369 | 083SM-L369-F | SEQ ID NO: 77 | A, C, D, F, G, H, I, M, N, P, R, S, T, V | A, C, D, F, G, I, M, T, V |
|  | 083SM-L369-R | SEQ ID NO: 78 |  |  |
| L370 | 083SM-L370-F | SEQ ID NO: 79 | A, C, D, E, F, G, H, I, K, M, N, P, Q, R, S, T, V, W, Y | A, C, D, E, F, G, H, I, K, M, Q, R, S, T, V, W, Y |
|  | 083SM-L370-R | SEQ ID NO: 80 |  |  |
| Q371 | 083SM-Q371-F | SEQ ID NO: 81 | A, C, D, E, F, G, I, K, L, N, R, S, T, V, W | A, C, D, E, F, G, I, K, L, N, R, S, T, V, W |
|  | 083SM-Q371-R | SEQ ID NO: 82 |  |  |
| Q372 | 083SM-Q372-F | SEQ ID NO: 83 | A, C, D, F, G, H, I, L, N, R, S, T, V, Y | A, C, D, F, G, H, I, L, N, R, S, V, Y |
|  | 083SM-Q372-R | SEQ ID NO: 84 |  |  |
| N373 | 083SM-N373-F | SEQ ID NO: 85 | A, C, D, F, G, H, I, K, L, M, P, Q, R, S, T, V, W, Y | A, C, D, F, G, H, I, K, Q, S, T, V, W |
|  | 083SM-N373-R | SEQ ID NO: 86 |  |  |

TABLE 16

| Position | Oligo name | Primer Sequence | Identified substitutions | Active substitutions |
|---|---|---|---|---|
| W556 | 083SM-W556-F | SEQ ID NO: 87 | A, C, D, F, G, I, K, L, M, N, P, Q, R, S, T, V, Y | F, T, Y |
|  | 083SM-W556-R | SEQ ID NO: 88 |  |  |
| R557 | 083SM-R557-F | SEQ ID NO: 89 | C, D, G, H, I, K, L, M, N, P, Q, S, T, V, W, Y | C, D, G, H, I, K, L, M, N, P, Q, S, T, V, W, Y |
|  | 083SM-R557-R | SEQ ID NO: 90 |  |  |
| A558 | 083SM-A558-F | SEQ ID NO: 91 | C, D, F, G, H, I, K, L, N, P, Q, R, S, V, W, Y | C, D, F, G, H, I, K, L, N, P, Q, R, S, V, W, Y |
|  | 083SM-A558-R | SEQ ID NO: 92 |  |  |
| K559 | 083SM-K559-F | SEQ ID NO: 93 | A, C, F, G, H, I, L, N, P, Q, R, S, T, V, Y | A, C, F, G, H, I, L, N, Q, R, S, T, V, Y |
|  | 083SM-K559-R | SEQ ID NO: 94 |  |  |

TABLE 16-continued

| Position | Oligo name | Primer Sequence | Identified substitutions | Active substitutions |
|---|---|---|---|---|
| C560 | 083SM-C560-F | SEQ ID NO: 95 | A, D, F, G, H, I, K, L, M, N, P, Q, R, S, T, V, Y | A, F, G, I, M, N, R, S, T, V |
|  | 083SM-C560-R | SEQ ID NO: 96 |  |  |
| K561 | 083SM-K561-F | SEQ ID NO: 97 | A, C, D, E, F, G, H, I, L, M, N, P, R, S, T, V, Y | A, C, D, E, F, G, H, I, L, M, N, R, S, T, V, Y |
|  | 083SM-K561-R | SEQ ID NO: 98 |  |  |
| N562 | 083SM-N562-F | SEQ ID NO: 99 | A, C, D, E, F, G, H, K, L, M, P, R, S, T, V, W, Y | C, D, E, G, H, L, M, R, S, T, V, Y |
|  | 083SM-N562-R | SEQ ID NO: 100 |  |  |
| V563 | 083SM-V563-F | SEQ ID NO: 101 | A, C, D, F, G, H, I, K, L, M, N, P, Q, R, S, T, W | A, C, D, F, H, I, L, M, N, Q, T, W |
|  | 083SM-V563-R | SEQ ID NO: 102 |  |  |
| A564 | 083SM-A564-F | SEQ ID NO: 103 | C, D, F, G, H, I, K, L, M, N, P, Q, R, S, T, V, W, Y | C, G, M, Q, S, T, V, W, Y |
|  | 083SM-A564-R | SEQ ID NO: 104 |  |  |

TABLE 17

| Position | Oligo name | Oligo Sequence | Identified substitutions | Active substitutions |
|---|---|---|---|---|
| L646 | 083SM-L646-F | SEQ ID NO: 105 | A, C, D, E, F, G, H, I, K, M, N, P, Q, R, S, T, V, W, Y | A, C, G, I, M, N, Q, S, T, V |
|  | 083SM-L646-R | SEQ ID NO: 106 |  |  |
| L647 | 083SM-L647-F | SEQ ID NO: 107 | A, D, F, G, H, I, K, M, N, P, Q, R, S, T, V, W, Y | D, G, M, N, Q, T |
|  | 083SM-L647-R | SEQ ID NO: 108 |  |  |
| M648 | 083SM-M648-F | SEQ ID NO: 109 | A, C, D, E, F, G, H, K, L, N, P, Q, R, S, T, V, W, Y | A, C, D, E, F, G, H, K, L, N, P, Q, R, S, T, V, W, Y |
|  | 083SM-M648-R | SEQ ID NO: 110 |  |  |
| P649 | 083SM-P649-F | SEQ ID NO: 111 | A, C, D, E, F, G, H, I, K, L, M, N, Q, R, S, T, V, W, Y | A, C, D, E, F, G, H, K, M, N, Q, R, S, T, W, Y |
|  | 083SM-P649-R | SEQ ID NO: 112 |  |  |
| T650 | 083SM-T650-F | SEQ ID NO: 113 | A, C, D, F, G, H, I, K, L, M, P, Q, R, S, V, Y | A, C, D, F, G, H, I, K, L, M, P, Q, R, S, V, Y |
|  | 083SM-T650-R | SEQ ID NO: 114 |  |  |
| E651 | 083SM-E651-F | SEQ ID NO: 115 | A, C, D, G, H, I, K, L, M, N, P, Q, R, S, T, V, W, Y | A, C, D, G, H, I, L, M, N, P, Q, R, S, T, V, Y |
|  | 083SM-E651-R | SEQ ID NO: 116 |  |  |
| L652 | 083SM-L652-F | SEQ ID NO: 117 | A, C, D, E, F, G, H, I, K, M, N, P, Q, R, S, T, V, Y | C, F, I, K, M, P, R, S, T, V |
|  | 083SM-L652-R | SEQ ID NO: 118 |  |  |
| T653 | 083SM-T653-F | SEQ ID NO: 119 | C, D, E, F, G, H, I, K, L, P, R, S, V, W | C, D, E, F, G, H, I, K, L, P, R, S, V, W |
|  | 083SM-T653-R | SEQ ID NO: 120 |  |  |
| T654 | 083SM-T654-F | SEQ ID NO: 121 | A, C, F, H, I, K, L, M, N, P, Q, R, S, V, W, Y | A, C, F, I, K, L, M, P, R, S, V, W, Y |
|  | 083SM-T654-R | SEQ ID NO: 122 |  |  |
| W655 | 083SM-W655-F | SEQ ID NO: 123 | A, C, E, F, G, L, N, Q, R, S, T, V, Y | F, Y |
|  | 083SM-W655-R | SEQ ID NO: 124 |  |  |

TABLE 18

| Position | Oligo name | Primer Sequence | Identified substitutions | Active substitutions |
|---|---|---|---|---|
| R771 | 083SM-R771-F | SEQ ID NO: 125 | A, C, D, E, F, G, H, I, K, L, N, P, S, T, V, W, Y | A, D, E, F, G, H, I, K, L, N, S, T, V, W, Y |
|  | 083SM-R771-R | SEQ ID NO: 126 |  |  |
| R772 | 083SM-R772-F | SEQ ID NO: 127 | A, C, D, E, F, G, H, I, K, L, M, P, Q, S, T, V, W, Y | A, C, D, E, F, G, H, I, K, L, M, P, Q, S, T, V, W, Y |
|  | 083SM-R772-R | SEQ ID NO: 128 |  |  |
| D773 | 083SM-D773-F | SEQ ID NO: 129 | A, C, E, F, G, H, I, K, L, M, N, P, Q, R, S, T, V, W, Y | A, E, F, G, H, I, K, L, M, N, Q, R, S, T, V, W, Y |
|  | 083SM-D773-R | SEQ ID NO: 130 |  |  |
| Q774 | 083SM-Q774-F | SEQ ID NO: 131 | A, D, G, H, I, K, L, M, N, P, R, S, T, V, W, Y | A, D, G, H, I, K, L, M, N, P, R, S, T, V, W, Y |
|  | 083SM-Q774-R | SEQ ID NO: 132 |  |  |
| V775 | 083SM-V775-F | SEQ ID NO: 133 | A, C, D, E, G, H, I, L, M, N, P, Q, R, S, T, Y | A, C, D, E, G, H, I, N, P, Q, R, S, T, Y |
|  | 083SM-V775-R | SEQ ID NO: 134 |  |  |
| L776 | 083SM-L776-F | SEQ ID NO: 135 | A, C, D, E, F, G, H, I, K, N, P, Q, R, S, T, V, W, Y | A, C, D, E, F, G, H, I, K, N, P, Q, R, S, T, V, Y |
|  | 083SM-L776-R | SEQ ID NO: 136 |  |  |
| P777 | 083SM-P777-F | SEQ ID NO: 137 | A, C, D, E, F, G, H, K, L, M, N, Q, R, S, T, V, W, Y | A, C, D, E, F, G, H, K, L, M, N, Q, S, T, V, W, Y |
|  | 083SM-P777-R | SEQ ID NO: 138 |  |  |
| F778 | 083SM-F778-F | SEQ ID NO: 139 | A, D, G, H, I, K, L, M, N, P, Q, R, S, T, V, W, Y | A, H, I, L, M, N, Q, S, V, W, Y |
|  | 083SM-F778-R | SEQ ID NO: 140 |  |  |
| Q779 | 083SM-Q779-F | SEQ ID NO: 141 | A, C, D, E, F, G, H, I, K, L, N, P, R, S, T, V, W | A, C, D, E, G, H, K, L, N, P, R, S, T, V |
|  | 083SM-Q779-R | SEQ ID NO: 142 |  |  |
| A780 | 083SM-A780-F | SEQ ID NO: 143 | C, D, E, F, G, H, K, L, N, P, Q, R, S, T, V, W, Y | C, N, P, Q, S |
|  | 083SM-A780-R | SEQ ID NO: 144 |  |  |
| A781 | 083SM-A781-F | SEQ ID NO: 145 | C, D, E, F, G, H, I, L, M, N, P, Q, R, S, T, V, W, Y | C, D, E, F, G, H, I, N, Q, R, S, T, V, W, Y |
|  | 083SM-A781-R | SEQ ID NO: 146 |  |  |
| A782 | 083SM-A782-F | SEQ ID NO: 147 | C, D, E, F, G, H, I, K, L, M, N, P, Q, R, S, T, V, W, Y | C, D, E, F, G, H, I, K, M, P, Q, R, S, T, V, W, Y |
|  | 083SM-A782-R | SEQ ID NO: 148 |  |  |
| P783 | 083SM-P783-F | SEQ ID NO: 149 | A, C, D, E, F, G, H, I, L, M, N, Q, R, S, T, V, Y | A, C, D, E, G, H, N, Q, R, S, T, V |
|  | 083SM-P783-R | SEQ ID NO: 150 |  |  |

TABLE 18-continued

| Position | Oligo name | Primer Sequence | Identified substitutions | Active substitutions |
|---|---|---|---|---|
| L784 | 083SM-L784-F | SEQ ID NO: 151 | A, C, D, E, F, G, H, I, K, M, N, P, Q, R, | A, E, F, H, I, K, M, N, P, Q, S, T, |
|  | 083SM-L784-R | SEQ ID NO: 152 | S, T, V, W, Y | V, W |
| N785 | 083SM-N785-F | SEQ ID NO: 153 | A, C, E, F, G, H, I, K, L, M, P, Q, R, S, | A, C, E, F, G, H, I, K, L, M, Q, R, |
|  | 083SM-N785-R | SEQ ID NO: 154 | T, V, W, Y | S, T, V, W, Y |
| Y786 | 083SM-Y786-F | SEQ ID NO: 155 | C, D, E, F, G, H, I, K, L, M, N, P, Q, R, | F, I, L, W |
|  | 083SM-Y786-R | SEQ ID NO: 156 | S, T, V, W |  |

Example 12—PtIP-83Aa Variants with Multiple Amino Acid Substitutions in Motif A or Motif C PtIP-83Aa variants with multiple amino acid substitutions within a motif were constructed for Motif A and Motif C using either the QuikChange® Lightning Site-Directed Mutagenesis Kit (Agilent) (as described in Example 11), or by multi-PCR fragment overlap assembly (Gibson Assembly Cloning Kit, New England Biolabs Inc.) into a plant transient vector containing the viral DMMV promoter. Primers used in constructing combinations of mutations within an individual motif are summarized in Table 19. The resulting combinatory libraries were transformed into *Agrobacterium* for plant transient expression and subsequent SBL activity assays as described in Example 4. Active variants, defined as having an average activity score of <=60% of leaf disk eaten, were sent for sequence identification.

TABLE 19

| Library | Primer | Sequence |
|---|---|---|
| Motif A Combi -1 | 83M1-CombiF1 | CTCGAGGGAGCCGAGAAAGTGA DGCRSYTCTATRTCTTKDSCGA CRTCV

TABLE 20-continued

| Variants | DNA sequence | Motif A amino acid sequence | Additional mutations | Total # Mut. |
|---|---|---|---|---|
| PtIP-83cmbM1-3 SEQ ID NO: 238 | SEQ ID NO: 174 | VKHLYIFSDIIELP (a.a. 53-66 of SEQ ID NO: 238) | | 5 |
| PtIP-83cmbM1-4 SEQ ID NO: 239 | SEQ ID NO: 175 | VKHLYIFTDVLELP (a.a. 53-66 of SEQ ID NO: 239) | | 4 |
| PtIP-83cmbM1-5 SEQ ID NO: 240 | SEQ ID NO: 176 | VKHLYVFADIIVLP (a.a. 53-66 of SEQ ID NO: 240) | | 4 |
| PtIP-83cmbM1-6 SEQ ID NO: 241 | SEQ ID NO: 177 | VKHLYVFADVIELP (a.a. 53-66 of SEQ ID NO: 241) | | 2 |
| PtIP-83cmbM1-7 SEQ ID NO: 242 | SEQ ID NO: 178 | VKHLYVFGDVIELP (a.a. 53-66 of SEQ ID NO: 242) | | 3 |
| PtIP-83cmbM1-8 SEQ ID NO: 243 | SEQ ID NO: 179 | VKHLYVFSDVIELP (a.a. 53-66 of SEQ ID NO: 243) | | 3 |
| PtIP-83cmbM1-9 SEQ ID NO: 244 | SEQ ID NO: 180 | VKHLYVFSDVLVLP (a.a. 53-66 of SEQ ID NO: 244) | | 4 |
| PtIP-83cmbM1-10 SEQ ID NO: 245 | SEQ ID NO: 181 | VKQLIIFSDIIELP (a.a. 53-66 of SEQ ID NO: 245) | | 6 |
| PtIP-83cmbM1-11 SEQ ID NO: 246 | SEQ ID NO: 182 | VKQLYIFCDIIELP (a.a. 53-66 of SEQ ID NO: 246) | | 5 |
| PtIP-83cmbM1-12 SEQ ID NO: 247 | SEQ ID NO: 183 | VKQLYIFCDVLELP (a.a. 53-66 of SEQ ID NO: 247) | | 4 |
| PtIP-83cmbM1-13 SEQ ID NO: 248 | SEQ ID NO: 184 | VKQLYIFGDVIELP (a.a. 53-66 of SEQ ID NO: 248) | | 4 |
| PtIP-83cmbM1-14 SEQ ID NO: 249 | SEQ ID NO: 185 | VKQLYIFSDIIELP (a.a. 53-66 of SEQ ID NO: 249) | V24I | 6 |
| PtIP-83cmbM1-15 SEQ ID NO: 250 | SEQ ID NO: 186 | VKQLYVFCDILELP (a.a. 53-66 of SEQ ID NO: 250) | | 4 |
| PtIP-83cmbM1-16 SEQ ID NO: 251 | SEQ ID NO: 187 | VKQLYVFSDILELP (a.a. 53-66 of SEQ ID NO: 251) | | 4 |
| PtIP-83cmbM1-17 SEQ ID NO: 252 | SEQ ID NO: 188 | VKQLYVFSDVLVLP (a.a. 53-66 of SEQ ID NO: 252) | | 4 |
| PtIP-83cmbM1-18 SEQ ID NO: 253 | SEQ ID NO: 189 | VKRFYIFADIVELP (a.a. 53-66 of SEQ ID NO: 253) | | 3 |
| PtIP-83cmbM1-19 SEQ ID NO: 254 | SEQ ID NO: 190 | VKRFYIFSDIIELP (a.a. 53-66 of SEQ ID NO: 254) | | 5 |
| PtIP-83cmbM1-20 SEQ ID NO: 255 | SEQ ID NO: 191 | VKRFYVFSDIVELP (a.a. 53-66 of SEQ ID NO: 255) | | 3 |
| PtIP-83cmbM1-21 SEQ ID NO: 256 | SEQ ID NO: 192 | VKRLVILGDIVVP (a.a. 53-66 of SEQ ID NO: 256) | | 8 |
| PtIP-83cmbM1-22 SEQ ID NO: 257 | SEQ ID NO: 193 | VKRLYIFADIIELP (a.a. 53-66 of SEQ ID NO: 257) | | 3 |
| PtIP-83cmbM1-23 SEQ ID NO: 258 | SEQ ID NO: 194 | VKRLYIFCDIIVLP (a.a. 53-66 of SEQ ID NO: 258) | | 5 |
| PtIP-83cmbM1-24 SEQ ID NO: 259 | SEQ ID NO: 195 | VKRLYIFCDIVELP (a.a. 53-66 of SEQ ID NO: 259) | | 3 |
| PtIP-83cmbM1-25 SEQ ID NO: 260 | SEQ ID NO: 196 | VKRLYIFGDIIELP (a.a. 53-66 of SEQ ID NO: 260) | P74A | 5 |
| PtIP-83cmbM1-26 SEQ ID NO: 261 | SEQ ID NO: 197 | VKRLYIFGDVIELP (a.a. 53-66 of SEQ ID NO: 261) | | 3 |
| PtIP-83cmbM1-27 SEQ ID NO: 262 | SEQ ID NO: 198 | VKRLYIFSDIIVLP (a.a. 53-66 of SEQ ID NO: 262) | | 5 |
| PtIP-83cmbM1-28 SEQ ID NO: 263 | SEQ ID NO: 199 | VKRLYIFSDILELP (a.a. 53-66 of SEQ ID NO: 263) | | 4 |

TABLE 20-continued

| Variants | DNA sequence | Motif A amino acid sequence | Additional mutations | Total # Mut. |
|---|---|---|---|---|
| PtIP-83cmbM1-29 SEQ ID NO: 264 | SEQ ID NO: 200 | VKRLYIFSDVIVLP (a.a. 53-66 of SEQ ID NO: 264) | | 4 |
| PtIP-83cmbM1-30 SEQ ID NO: 265 | SEQ ID NO: 201 | VKRLYIFTDVIELP (a.a. 53-66 of SEQ ID NO: 265) | | 3 |
| PtIP-83cmbM1-31 SEQ ID NO: 266 | SEQ ID NO: 202 | VKRLYVFCDIIELP (a.a. 53-66 of SEQ ID NO: 266) | | 3 |
| PtIP-83cmbM1-32 SEQ ID NO: 267 | SEQ ID NO: 203 | VKRLYVFCDIIVLP (a.a. 53-66 of SEQ ID NO: 267) | | 4 |
| PtIP-83cmbM1-33 SEQ ID NO: 268 | SEQ ID NO: 204 | VKRLYVFGDIVELP (a.a. 53-66 of SEQ ID NO: 268) | | 2 |
| PtIP-83cmbM1-34 SEQ ID NO: 269 | SEQ ID NO: 205 | VKRLYVFGDVVELP (a.a. 53-66 of SEQ ID NO: 269) | | 1 |
| PtIP-83cmbM1-35 SEQ ID NO: 270 | SEQ ID NO: 206 | VKRLYVFSDIIELP (a.a. 53-66 of SEQ ID NO: 270) | | 3 |
| PtIP-83cmbM1-36 SEQ ID NO: 271 | SEQ ID NO: 207 | VKRLYVFSDIVELP (a.a. 53-66 of SEQ ID NO: 271) | | 2 |
| PtIP-83cmbM1-37 SEQ ID NO: 272 | SEQ ID NO: 208 | VKRLYVFSDVIELP (a.a. 53-66 of SEQ ID NO: 272) | | 2 |
| PtIP-83cmbM1-38 SEQ ID NO: 273 | SEQ ID NO: 209 | VKRLYVFTDVIVLP (a.a. 53-66 of SEQ ID NO: 273) | | 3 |
| PtIP-83cmbM1-39 SEQ ID NO: 274 | SEQ ID NO: 210 | VKRLYVFTDVVVLP (a.a. 53-66 of SEQ ID NO: 274) | | 2 |
| PtIP-83cmbM1-40 SEQ ID NO: 275 | SEQ ID NO: 211 | VMHLYIFADVIELP (a.a. 53-66 of SEQ ID NO: 275) | | 4 |
| PtIP-83cmbM1-41 SEQ ID NO: 276 | SEQ ID NO: 212 | VMQLYIFCDILELP (a.a. 53-66 of SEQ ID NO: 276) | P74T | 7 |
| PtIP-83cmbM1-42 SEQ ID NO: 277 | SEQ ID NO: 213 | VMRLYIFADVVVLP (a.a. 53-66 of SEQ ID NO: 277) | | 3 |
| PtIP-83cmbM1-43 SEQ ID NO: 278 | SEQ ID NO: 214 | VMRLYIFCDVIELP (a.a. 53-66 of SEQ ID NO: 278) | | 4 |
| PtIP-83cmbM1-44 SEQ ID NO: 279 | SEQ ID NO: 215 | VMRLYVFCDIIELP (a.a. 53-66 of SEQ ID NO: 279) | | 4 |
| PtIP-83cmbM1-45 SEQ ID NO: 280 | SEQ ID NO: 216 | VMRLYVFCDILVLP (a.a. 53-66 of SEQ ID NO: 280) | | 5 |
| PtIP-83cmbM1-46 SEQ ID NO: 281 | SEQ ID NO: 217 | VMRLYVFSDIIVLP (a.a. 53-66 of SEQ ID NO: 281) | | 5 |
| PtIP-83cmbM1-47 SEQ ID NO: 282 | SEQ ID NO: 218 | VRHLYIFADIIELP (a.a. 53-66 of SEQ ID NO: 282) | | 5 |
| PtIP-83cmbM1-48 SEQ ID NO: 283 | SEQ ID NO: 219 | VRHLYIFADVVELP (a.a. 53-66 of SEQ ID NO: 283) | | 3 |
| PtIP-83cmbM1-49 SEQ ID NO: 284 | SEQ ID NO: 220 | VRHLYIFCDVIELP (a.a. 53-66 of SEQ ID NO: 284) | | 5 |
| PtIP-83cmbM1-50 SEQ ID NO: 285 | SEQ ID NO: 221 | VRHLYIFSDVIELP (a.a. 53-66 of SEQ ID NO: 285) | | 5 |
| PtIP-83cmbM1-51 SEQ ID NO: 286 | SEQ ID NO: 222 | VRHLYIFSDVVELP (a.a. 53-66 of SEQ ID NO: 286) | | 4 |
| PtIP-83cmbM1-52 SEQ ID NO: 287 | SEQ ID NO: 223 | VRHLYVFTDVLELP (a.a. 53-66 of SEQ ID NO: 287) | | 4 |
| PtIP-83cmbM1-53 SEQ ID NO: 288 | SEQ ID NO: 224 | VRQLYIFCDVIVLP (a.a. 53-66 of SEQ ID NO: 288) | | 6 |
| PtIP-83cmbM1-54 SEQ ID NO: 289 | SEQ ID NO: 225 | VRQLYIFSDVVVLP (a.a. 53-66 of SEQ ID NO: 289) | | 5 |

TABLE 20-continued

| Variants | DNA sequence | Motif A amino acid sequence | Additional mutations | Total # Mut. |
|---|---|---|---|---|
| PtIP-83cmbM1-55 SEQ ID NO: 290 | SEQ ID NO: 226 | VRQLYVFCDVLVLP (a.a. 53-66 of SEQ ID NO: 290) | | 5 |
| PtIP-83cmbM1-56 SEQ ID NO: 291 | SEQ ID NO: 227 | VRRLYIFADILELP (a.a. 53-66 of SEQ ID NO: 291) | | 4 |
| PtIP-83cmbM1-57 SEQ ID NO: 292 | SEQ ID NO: 228 | VRRLYIFADIVELP (a.a. 53-66 of SEQ ID NO: 292) | P74A | 4 |
| PtIP-83cmbM1-58 SEQ ID NO: 293 | SEQ ID NO: 229 | VRRLYIFGDIVELP (a.a. 53-66 of SEQ ID NO: 293) | | 4 |
| PtIP-83cmbM1-59 SEQ ID NO: 294 | SEQ ID NO: 230 | VRRLYIFTDIIELP (a.a. 53-66 of SEQ ID NO: 294) | | 5 |
| PtIP-83cmbM1-60 SEQ ID NO: 295 | SEQ ID NO: 231 | VRRLYVFADIIDLP (a.a. 53-66 of SEQ ID NO: 295) | | 4 |
| PtIP-83cmbM1-61 SEQ ID NO: 296 | SEQ ID NO: 232 | VRRLYVFADIVVLP (a.a. 53-66 of SEQ ID NO: 296) | | 3 |
| PtIP-83cmbM1-62 SEQ ID NO: 297 | SEQ ID NO: 233 | VRRLYVFCDVVVLP (a.a. 53-66 of SEQ ID NO: 297) | | 3 |
| PtIP-83cmbM1-63 SEQ ID NO: 298 | SEQ ID NO: 234 | VRRLYVFTDIIELP (a.a. 53-66 of SEQ ID NO: 298) | | 4 |
| PtIP-83cmbM1-64 SEQ ID NO: 299 | SEQ ID NO: 235 | VRRLYVFTDVLVLP (a.a. 53-66 of SEQ ID NO: 299) | | 4 |

A single combination library of Motif C containing potential mutations at positions R557, A558, K559, K561, and N562 of PtIP-83Aa (SEQ ID NO: 1) was screened. From a total of 233 variants screened from Motif C Combi, 34 active unique sequence variants were identified. Table 21 summarizes the amino acid substitutions of the resulting active PtIP-83Aa Motif C variants as compared to PtIP-83Aa.

TABLE 21

| Variants | DNA sequence | AA sequence | Additional mutations | Total Mutations |
|---|---|---|---|---|
| PtIP-83Aa SEQ ID NO: 1 | SEQ ID NO: 2 | WRAKCKNVA (a.a. 556-564 of SEQ ID NO: 1) | | 0 |
| PtIP-83cmbM3-1 SEQ ID NO: 334 | SEQ ID NO: 300 | WHARCKSVA (a.a. 556-564 of SEQ ID NO: 334) | | 3 |
| PtIP-83cmbM3-2 SEQ ID NO: 335 | SEQ ID NO: 301 | WHGKCKNVA (a.a. 556-564 of SEQ ID NO: 335) | | 2 |
| PtIP-83cmbM3-3 SEQ ID NO: 336 | SEQ ID NO: 302 | WIAKCKCVA (a.a. 556-564 of SEQ ID NO: 336) | | 2 |
| PtIP-83cmbM3-4 SEQ ID NO: 337 | SEQ ID NO: 303 | WIAKCKSVA (a.a. 556-564 of SEQ ID NO: 337) | | 2 |
| PtIP-83cmbM3-5 SEQ ID NO: 338 | SEQ ID NO: 304 | WIGKCKNVA (a.a. 556-564 of SEQ ID NO: 338) | | 2 |
| PtIP-83cmbM3-6 SEQ ID NO: 339 | SEQ ID NO: 305 | WIGKCKSVA (a.a. 556-564 of SEQ ID NO: 339) | | 3 |
| PtIP-83cmbM3-7 SEQ ID NO: 340 | SEQ ID NO: 306 | WIGKCNNVA (a.a. 556-564 of SEQ ID NO: 340) | | 3 |
| PtIP-83cmbM3-8 SEQ ID NO: 341 | SEQ ID NO: 307 | WIVKCKSVA (a.a. 556-564 of SEQ ID NO: 341) | | 3 |
| PtIP-83cmbM3-9 SEQ ID NO: 342 | SEQ ID NO: 308 | WLARCKNVA (a.a. 556-564 of SEQ ID NO: 342) | | 2 |
| PtIP-83cmbM3-10 SEQ ID NO: 343 | SEQ ID NO: 309 | WLARCKSVA (a.a. 556-564 of SEQ ID NO: 343) | | 3 |

TABLE 21-continued

| Variants | DNA sequence | AA sequence | Additional mutations | Total Mutations |
|---|---|---|---|---|
| PtIP-83cmbM3-11 SEQ ID NO: 344 | SEQ ID NO: 310 | WLGRCKNVA (a.a. 556-564 of SEQ ID NO: 344) | | 3 |
| PtIP-83cmbM3-12 SEQ ID NO: 345 | SEQ ID NO: 311 | WLGRCKSVA (a.a. 556-564 of SEQ ID NO: 345) | | 4 |
| PtIP-83cmbM3-13 SEQ ID NO: 346 | SEQ ID NO: 312 | WLVKCKCVA (a.a. 556-564 of SEQ ID NO: 346) | | 3 |
| PtIP-83cmbM3-14 SEQ ID NO: 347 | SEQ ID NO: 313 | WMAKCKNVA (a.a. 556-564 of SEQ ID NO: 347) | A502S | 2 |
| PtIP-83cmbM3-15 SEQ ID NO: 348 | SEQ ID NO: 314 | WMGRCKSVA (a.a. 556-564 of SEQ ID NO: 348) | | 4 |
| PtIP-83cmbM3-16 SEQ ID NO: 349 | SEQ ID NO: 315 | WMVKCKNVA (a.a. 556-564 of SEQ ID NO: 349) | | 2 |
| PtIP-83cmbM3-17 SEQ ID NO: 350 | SEQ ID NO: 316 | WMVKCKSVA (a.a. 556-564 of SEQ ID NO: 350) | | 3 |
| PtIP-83cmbM3-18 SEQ ID NO: 351 | SEQ ID NO: 317 | WMVRCKNVA (a.a. 556-564 of SEQ ID NO: 351) | | 3 |
| PtIP-83cmbM3-19 SEQ ID NO: 352 | SEQ ID NO: 318 | WQARCKHVA (a.a. 556-564 of SEQ ID NO: 352) | | 3 |
| PtIP-83cmbM3-20 SEQ ID NO: 353 | SEQ ID NO: 319 | WQARCKNVA (a.a. 556-564 of SEQ ID NO: 353) | K505N | 3 |
| PtIP-83cmbM3-21 SEQ ID NO: 354 | SEQ ID NO: 320 | WQGRCKNVA (a.a. 556-564 of SEQ ID NO: 354) | | 3 |
| PtIP-83cmbM3-22 SEQ ID NO: 355 | SEQ ID NO: 321 | WQVRCKSVA (a.a. 556-564 of SEQ ID NO: 355) | | 4 |
| PtIP-83cmbM3-23 SEQ ID NO: 356 | SEQ ID NO: 322 | WRARCKNVA (a.a. 556-564 of SEQ ID NO: 356) | T573A | 2 |
| PtIP-83cmbM3-24 SEQ ID NO: 357 | SEQ ID NO: 323 | WRGKCKSVA (a.a. 556-564 of SEQ ID NO: 357) | | 2 |
| PtIP-83cmbM3-25 SEQ ID NO: 358 | SEQ ID NO: 324 | WRGRCKTVA (a.a. 556-564 of SEQ ID NO: 358) | | 3 |
| PtIP-83cmbM3-26 SEQ ID NO: 359 | SEQ ID NO: 325 | WSARCKSVA (a.a. 556-564 of SEQ ID NO: 359) | | 3 |
| PtIP-83cmbM3-27 SEQ ID NO: 360 | SEQ ID NO: 326 | WSVKCKHVA (a.a. 556-564 of SEQ ID NO: 360) | | 3 |
| PtIP-83cmbM3-28 SEQ ID NO: 361 | SEQ ID NO: 327 | WTGRCKTVA (a.a. 556-564 of SEQ ID NO: 361) | | 4 |
| PtIP-83cmbM3-29 SEQ ID NO: 362 | SEQ ID NO: 328 | WTGRCNHVA (a.a. 556-564 of SEQ ID NO: 362) | R568Q | 6 |
| PtIP-83cmbM3-30 SEQ ID NO: 363 | SEQ ID NO: 329 | WTVKCKNVA (a.a. 556-564 of SEQ ID NO: 363) | | 2 |
| PtIP-83cmbM3-31 SEQ ID NO: 364 | SEQ ID NO: 330 | WTVKCKSVA (a.a. 556-564 of SEQ ID NO: 364) | | 3 |
| PtIP-83cmbM3-32 SEQ ID NO: 365 | SEQ ID NO: 331 | WTVRCKNVA (a.a. 556-564 of SEQ ID NO: 365) | | 3 |
| PtIP-83cmbM3-33 SEQ ID NO: 366 | SEQ ID NO: 332 | WRARCKHVA (a.a. 556-564 of SEQ ID NO: 366) | | 2 |
| PtIP-83cmbM3-34 SEQ ID NO: 367 | SEQ ID NO: 333 | WIGRCKSVA (a.a. 556-564 of SEQ ID NO: 367) | | 4 |

Example 13—PtIP-83Aa Variants with Multiple Amino Acid Substitutions in Motif A and Motif C Additional sequence diversity was created by combining active Motif A combinations with active Motif C combinations. Twenty four unique active Motif A combination variants and 11 unique active Motif C combination variants were selected for construction of a Motif A×Motif C Library (Table 22).

TABLE 22

| Sequence variants used for construction of Motif A × Motif C Combination Library | | |
|---|---|---|
| Motif A | | Motif C |
| PtIP-83cmbM1-1 SEQ ID NO: 236 | PtIP-83cmbM1-32 SEQ ID NO: 267 | PtIP-83cmbM3-2 SEQ ID NO: 335 |
| PtIP-83cmbM1-2 SEQ ID NO: 237 | PtIP-83cmbM1-35 SEQ ID NO: 270 | PtIP-83cmbM3-5 SEQ ID NO: 338 |
| PtIP-83cmbM1-4 SEQ ID NO: 239 | PtIP-83cmbM1-36 SEQ ID NO: 271 | PtIP-83cmbM3-9 SEQ ID NO: 342 |
| PtIP-83cmbM1-6 SEQ ID NO: 241 | PtIP-83cmbM1-37 SEQ ID NO: 272 | PtIP-83cmbM3-11 SEQ ID NO: 344 |
| PtIP-83cmbM1-12 SEQ ID NO: 247 | PtIP-83cmbM1-44 SEQ ID NO: 279 | PtIP-83cmbM3-16 SEQ ID NO: 349 |
| PtIP-83cmbM1-15 SEQ ID NO: 250 | PtIP-83cmbM1-49 SEQ ID NO: 284 | PtIP-83cmbM3-19 SEQ ID NO: 352 |
| PtIP-83cmbM1-16 SEQ ID NO: 251 | PtIP-83cmbM1-51 SEQ ID NO: 286 | PtIP-83cmbM3-20 SEQ ID NO: 353 |
| PtIP-83cmbM1-18 SEQ ID NO: 253 | PtIP-83cmbM1-55 SEQ ID NO: 290 | PtIP-83cmbM3-23 SEQ ID NO: 356 |
| PtIP-83cmbM1-21 SEQ ID NO: 256 | PtIP-83cmbM1-56 SEQ ID NO: 291 | PtIP-83cmbM3-24 SEQ ID NO: 357 |
| PtIP-83cmbM1-22 SEQ ID NO: 257 | PtIP-83cmbM1-60 SEQ ID NO: 295 | PtIP-83cmbM3-25 SEQ ID NO: 358 |
| PtIP-83cmbM1-30 SEQ ID NO: 265 | PtIP-83cmbM1-62 SEQ ID NO: 297 | PtIP-83cmbM3-30 SEQ ID NO: 363 |
| PtIP-83cmbM1-31 SEQ ID NO: 266 | PtIP-83cmbM1-64 SEQ ID NO: 299 | |

Plasmid DNA was isolated from these variants and pooled by motif. Motif A combinations were PCR amplified from the Motif A pool using the following primers: AATCTCTCATCTAAGAGGCTGGATCCTAGGATGGCTCTCGTGGATTACGGC (SEQ ID NO: 630) and GCAGCCACAACCTCCATCACAGC (SEQ ID NO: 631). Motif C combinations were PCR amplified from the Motif C pool using the following primers: TGGCCAATCCAGAAGATGGACAAGTCTAGACTACTCTTCGTCGTGCCGCCAG (SEQ ID NO: 632) and GCTGTGATGGAGGTTGTGGCTGC (SEQ ID NO: 633). The two PCR products were then assembled by multi-PCR fragments overlap (Gibson Assembly Cloning Kit, New England Biolabs Inc) into a plant transient vector containing the viral DMMV promoter. 94 variants from this library were screened by plant transient expression and SBL activity assay as described in Example 4. 30 unique active variants, defined as having an average activity score of <=60% of leaf disk eaten, were identified by sequencing. Table 23 summarizes the amino acid substitutions of the resulting active PtIP-83Aa Motif A×Motif C variants as compared to PtIP-83Aa.

TABLE 23

| Variant | DNA sequence | Motif A sequence | Motif C sequence | Add. Mut. | Total Mut. |
|---|---|---|---|---|---|
| PtIP-83Aa SEQ ID NO: 1 | SEQ ID NO: 2 | VKRLYVFADVVELP (a.a. 53-66 of SEQ ID NO: 1) | WRAKCKNVA (a.a. 556-564 of SEQ ID NO: 1) | | 0 |
| PtIP-83cmbM1xM3-1 SEQ ID NO: 398 | SEQ ID NO: 368 | VKHLYIFTDVLELP (a.a. 53-66 of SEQ ID NO: 398) | WHGKCKNVA (a.a. 556-564 of SEQ ID NO: 398) | S533F | 7 |
| PtIP-83cmbM1xM3-2 SEQ ID NO: 399 | SEQ ID NO: 369 | VKHLYIFTDVLELP (a.a. 53-66 of SEQ ID NO: 399) | WLARCKNVA (a.a. 556-564 of SEQ ID NO: 399) | | 6 |
| PtIP-83cmbM1xM3-3 SEQ ID NO: 400 | SEQ ID NO: 370 | VKHLYIFTDVLELP (a.a. 53-66 of SEQ ID NO: 400) | WQARCKHVA (a.a. 556-564 of SEQ ID NO: 400) | | 7 |
| PtIP-83cmbM1xM3-4 SEQ ID NO: 401 | SEQ ID NO: 371 | VKHLYVFADVIELP (a.a. 53-66 of SEQ ID NO: 401) | WQARCKHVA (a.a. 556-564 of SEQ ID NO: 401) | | 5 |
| PtIP-83cmbM1xM3-5 SEQ ID NO: 402 | SEQ ID NO: 372 | VKHLYVFADVIELP (a.a. 53-66 of SEQ ID NO: 402) | WRARCKNVA (a.a. 556-564 of SEQ ID NO: 402) | | 3 |
| PtIP-83cmbM1xM3-6 SEQ ID NO: 403 | SEQ ID NO: 373 | VKQLYIFCDVLELP (a.a. 53-66 of SEQ ID NO: 403) | WQARCKNVA (a.a. 556-564 of SEQ ID NO: 403) | | 6 |
| PtIP-83cmbM1xM3-7 SEQ ID NO: 404 | SEQ ID NO: 374 | VKRFYIFADIVELP (a.a. 53-66 of SEQ ID NO: 404) | WIGKCKNVA (a.a. 556-564 of SEQ ID NO: 404) | | 5 |
| PtIP-83cmbM1xM3-8 SEQ ID NO: 405 | SEQ ID NO: 375 | VKRFYIFADIVELP (a.a. 53-66 of SEQ ID NO: 405) | WTVKCKNVA (a.a. 556-564 of SEQ ID NO: 405) | | 5 |
| PtIP-83cmbM1xM3-9 SEQ ID NO: 406 | SEQ ID NO: 376 | VKRLYIFADIIELP (a.a. 53-66 of SEQ ID NO: 406) | WMVKCKNVA (a.a. 556-564 of SEQ ID NO: 406) | | 5 |
| PtIP-83cmbM1xM3-10 SEQ ID NO: 407 | SEQ ID NO: 377 | VKRLYIFADIIELP (a.a. 53-66 of SEQ ID NO: 407) | WQARCKNVA (a.a. 556-564 of SEQ ID NO: 407) | | 5 |
| PtIP-83cmbM1xM3-11 SEQ ID NO: 408 | SEQ ID NO: 378 | VKRLYIFADIIELP (a.a. 53-66 of SEQ ID NO: 408) | WRGKCKSVA (a.a. 556-564 of SEQ ID NO: 408) | K52E, K505N | 7 |

TABLE 23-continued

| Variant | DNA sequence | Motif A sequence | Motif C sequence | Add. Mut. | Total Mut. |
|---|---|---|---|---|---|
| PtIP-83cmbM1xM3-12 SEQ ID NO: 409 | SEQ ID NO: 379 | VKRLYIFADIIELP (a.a. 53-66 of SEQ ID NO: 409) | WRGRCKTVA (a.a. 556-564 of SEQ ID NO: 409) | | 6 |
| PtIP-83cmbM1xM3-13 SEQ ID NO: 410 | SEQ ID NO: 380 | VKRLYIFTDVIELP (a.a. 53-66 of SEQ ID NO: 410) | WIGKCKNVA (a.a. 556-564 of SEQ ID NO: 410) | | 5 |
| PtIP-83cmbM1xM3-14 SEQ ID NO: 411 | SEQ ID NO: 381 | VKRLYVFCDIIELP (a.a. 53-66 of SEQ ID NO: 411) | WLARCKNVA (a.a. 556-564 of SEQ ID NO: 411) | | 5 |
| PtIP-83cmbM1xM3-15 SEQ ID NO: 412 | SEQ ID NO: 382 | VKRLYVFSDIIELP (a.a. 53-66 of SEQ ID NO: 412) | WIGKCKNVA (a.a. 556-564 of SEQ ID NO: 412) | | 5 |
| PtIP-83cmbM1xM3-16 SEQ ID NO: 413 | SEQ ID NO: 383 | VKRLYVFSDIIELP (a.a. 53-66 of SEQ ID NO: 413) | WRGRCKTVA (a.a. 556-564 of SEQ ID NO: 413) | | 6 |
| PtIP-83cmbM1xM3-17 SEQ ID NO: 414 | SEQ ID NO: 384 | VKRLYVFSDVIELP (a.a. 53-66 of SEQ ID NO: 414) | WRGKCKSVA (a.a. 556-564 of SEQ ID NO: 414) | | 4 |
| PtIP-83cmbM1xM3-18 SEQ ID NO: 415 | SEQ ID NO: 385 | VKRLYVFSDVIELP (a.a. 53-66 of SEQ ID NO: 415) | WRVKCKNVA (a.a. 556-564 of SEQ ID NO: 415) | | 3 |
| PtIP-83cmbM1xM3-19 SEQ ID NO: 416 | SEQ ID NO: 386 | VMRLYIFADVVELP (a.a. 53-66 of SEQ ID NO: 416) | WRGKCKSVA (a.a. 556-564 of SEQ ID NO: 416) | | 4 |
| PtIP-83cmbM1xM3-20 SEQ ID NO: 417 | SEQ ID NO: 387 | VRHLYIFCDVIELP (a.a. 53-66 of SEQ ID NO: 417) | WIGKCKNVA (a.a. 556-564 of SEQ ID NO: 417) | | 7 |
| PtIP-83cmbM1xM3-21 SEQ ID NO: 418 | SEQ ID NO: 388 | VRHLYIFSDVVELP (a.a. 53-66 of SEQ ID NO: 418) | WMVKCKNVA (a.a. 556-564 of SEQ ID NO: 418) | | 6 |
| PtIP-83cmbM1xM3-22 SEQ ID NO: 419 | SEQ ID NO: 389 | VRHLYIFSDVVELP (a.a. 53-66 of SEQ ID NO: 419) | WRGKCKSVA (a.a. 556-564 of SEQ ID NO: 419) | K505N | 7 |
| PtIP-83cmbM1xM3-23 SEQ ID NO: 420 | SEQ ID NO: 390 | VRQLYVFCDVLVLP (a.a. 53-66 of SEQ ID NO: 420) | WHGKCKNVA (a.a. 556-564 of SEQ ID NO: 420) | | 7 |
| PtIP-83cmbM1xM3-24 SEQ ID NO: 421 | SEQ ID NO: 391 | VRQLYVFCDVLVLP (a.a. 53-66 of SEQ ID NO: 421) | WLGRCKNVA (a.a. 556-564 of SEQ ID NO: 421) | | 8 |
| PtIP-83cmbM1xM3-25 SEQ ID NO: 422 | SEQ ID NO: 392 | VRQLYVFCDVLVLP (a.a. 53-66 of SEQ ID NO: 422) | WRGKCKSVA (a.a. 556-564 of SEQ ID NO: 422) | M1I | 8 |
| PtIP-83cmbM1xM3-26 SEQ ID NO: 423 | SEQ ID NO: 393 | VRRLYIFADILELP (a.a. 53-66 of SEQ ID NO: 423) | WMVKCKNVA (a.a. 556-564 of SEQ ID NO: 423) | | 6 |
| PtIP-83cmbM1xM3-27 SEQ ID NO: 424 | SEQ ID NO: 394 | VRRLYVFCDVVVLP (a.a. 53-66 of SEQ ID NO: 424) | WRARCKNVA (a.a. 556-564 of SEQ ID NO: 424) | | 4 |
| PtIP-83cmbM1xM3-28 SEQ ID NO: 425 | SEQ ID NO: 395 | VRRLYVFTDVLVLP (a.a. 53-66 of SEQ ID NO: 425) | WIGKCKNVA (a.a. 556-564 of SEQ ID NO: 425) | | 6 |
| PtIP-83cmbM1xM3-29 SEQ ID NO: 426 | SEQ ID NO: 396 | VRRLYVFTDVLVLP (a.a. 53-66 of SEQ ID NO: 426) | WRARCKNVA (a.a. 556-564 of SEQ ID NO: 426) | | 5 |
| PtIP-83cmbM1xM3-30 SEQ ID NO: 427 | SEQ ID NO: 397 | VRRLYVFTDVLVLP (a.a. 53-66 of SEQ ID NO: 427) | WTVKCKNVA (a.a. 556-564 of SEQ ID NO: 427) | | 6 |

Example 14 PtIP-83Aa Variants with Multiple Amino Acid Substitutions

To create variants of PtIP-83Aa (SEQ ID NO: 1) with multiple amino acid changes, variant libraries were generated by family shuffling (Chia-Chun J. Chang et al, 1999, *Nature Biotechnology* 17, 793-797) of the polynucleotide (SEQ ID NO: 2) encoding PtIP-83Aa (SEQ ID NO: 1) and the polynucleotide (SEQ ID NO: 2) encoding PtIP-83Cb (SEQ ID NO: 7). Mutation rates of the libraries were controlled by varying the regions of PtIP-83Aa (SEQ ID NO: 1) and PtIP-83Cb (SEQ ID NO: 7) which were included in the shuffling library reaction. Five libraries were generated between the two variants. In the first library (83FS-1), the full length gene sequence from both PtIP-83Aa (SEQ ID NO: 2) and PtIP-83Cb (SEQ ID NO: 8) were included in the shuffling reaction. In the second library (83FS-2), fragments containing nt: 1114-2604 of SEQ ID NO: 2 (encoding PtIP-83Aa (SEQ ID NO: 1)) and nt: 1072-2559 of SEQ ID NO: 8 (encoding PtIP-83Cb (SEQ ID NO: 7)) were shuffled. The shuffled fragments were then combined with nt: 1-1113 of SEQ ID NO: 2 (encoding PtIP-83Aa (SEQ ID NO: 1)) by Gibson Assembly (New England Biolabs). In a third library (83FS-3), the 5' and 3' regions of the two variants were shuffled in separate reactions. The 5' reaction, containing shuffled fragments from nt: 1-1113 of SEQ ID NO: 2 (encoding PtIP-83Aa (SEQ ID NO: 1)) and nt: 1-1071 of SEQ ID NO: 8 (encoding PtIP-83Cb (SEQ ID NO: 7)), and the 3' reaction, containing shuffled fragments from nt: 1114-2604 of SEQ ID NO: 2 (encoding PtIP-83Aa (SEQ ID NO:

1)) and nt: 1072-2559 of SEQ ID NO: 8 (encoding PtIP-83Cb (SEQ ID NO: 7)), were then combined by Gibson Assembly. In a fourth library (83FS-4), fragments from the 5' region of each variant (nt: 1-1113 of SEQ ID NO: 2 (encoding PtIP-83Aa (SEQ ID NO: 1)) and nt:1-1071 of SEQ ID NO: 8 (encoding PtIP-83Cb (SEQ ID NO: 7)) were shuffled with additional primers spiked into the assembly reaction to promote crossovers between the two variants. The shuffled 5' region was then combined by Gibson assembly with the 3' region of either SEQ ID NO: 2 (encoding PtIP-83Aa (SEQ ID NO: 1)) or SEQ ID NO: 8 (encoding PtIP-83Cb (SEQ ID NO: 7)). In the fifth library (83FS-5), single crossover variants were generated manually between SEQ ID NO: 2 (encoding PtIP-83Aa (SEQ ID NO: 1)) and SEQ ID NO: 8 (encoding PtIP-83Cb (SEQ ID NO: 7)) using Gibson assembly.

All shuffled libraries were cloned into a plant transient expression vector containing the viral dMMV promoter for subsequent transient expression in bush bean and SBL activity assays as described in Example 4. Active variants, defined as having an average activity score of ≤60% of leaf disk eaten, were sent for sequence identification. In library 83FS-1, 197 variants were screened and 45 active unique variants were sequence identified. In library 83FS-2, 96 variants were screened and 32 active unique variants were sequence identified. In library 83FS-3, 192 variants were screened and 13 active unique variants were sequence identified. In library 83FS-4, 96 variants were screened and 6 unique active variants were sequence identified. In library 83FS-5, four of the eleven constructed single cross variants were found to be active.

Sequence identity of active variants to PtIP-83Aa was calculated using the Needleman-Wunsch algorithm, as implemented in the Needle program (EMBOSS tool suite). The percent identity compared to PtIP-83Aa (SEQ ID NO: 1), variant designation, nucleotide sequences, and amino acid sequences of the resulting active PtIP-83Aa polypeptide variants from all libraries are summarized in Table 24. Table 25 summarizes the % identity of the active variants compared to PtIP-83Aa (SEQ ID NO: 1), the number of variants with each % identity, and the variant identification.

TABLE 24

| % Identity to PtIP-83Aa (SEQ ID NO: 1) | Variant | Polynucleotide | Polypeptide |
|---|---|---|---|
| 76 | S04359885 | SEQ ID NO: 428 | SEQ ID NO: 518 |
| 76 | S04359888 | SEQ ID NO: 429 | SEQ ID NO: 519 |
| 73 | S04359896 | SEQ ID NO: 430 | SEQ ID NO: 520 |
| 73 | S04359899 | SEQ ID NO: 431 | SEQ ID NO: 521 |
| 77 | S04359902 | SEQ ID NO: 432 | SEQ ID NO: 522 |
| 76 | S04359909 | SEQ ID NO: 433 | SEQ ID NO: 523 |
| 77 | S04359911 | SEQ ID NO: 434 | SEQ ID NO: 524 |
| 75 | S04359942 | SEQ ID NO: 435 | SEQ ID NO: 525 |
| 74 | S04359944 | SEQ ID NO: 436 | SEQ ID NO: 526 |
| 73 | S04359948 | SEQ ID NO: 437 | SEQ ID NO: 527 |
| 81 | S04359951 | SEQ ID NO: 438 | SEQ ID NO: 528 |
| 80 | S04359988 | SEQ ID NO: 439 | SEQ ID NO: 529 |
| 81 | S04359991 | SEQ ID NO: 440 | SEQ ID NO: 530 |
| 77 | S04360034 | SEQ ID NO: 441 | SEQ ID NO: 531 |
| 76 | S04360059 | SEQ ID NO: 442 | SEQ ID NO: 532 |
| 73 | S04360064 | SEQ ID NO: 443 | SEQ ID NO: 533 |
| 73 | S04360087 | SEQ ID NO: 444 | SEQ ID NO: 534 |
| 73 | S04360095 | SEQ ID NO: 445 | SEQ ID NO: 535 |
| 77 | S04360104 | SEQ ID NO: 446 | SEQ ID NO: 536 |
| 74 | S04360110 | SEQ ID NO: 447 | SEQ ID NO: 537 |
| 77 | S04360119 | SEQ ID NO: 448 | SEQ ID NO: 538 |
| 73 | S04360122 | SEQ ID NO: 449 | SEQ ID NO: 539 |
| 75 | S04360130 | SEQ ID NO: 450 | SEQ ID NO: 540 |
| 78 | S04360132 | SEQ ID NO: 451 | SEQ ID NO: 541 |
| 93 | S04360136 | SEQ ID NO: 452 | SEQ ID NO: 542 |
| 93 | S04360141 | SEQ ID NO: 453 | SEQ ID NO: 543 |

TABLE 24-continued

| % Identity to PtIP-83Aa (SEQ ID NO: 1) | Variant | Polynucleotide | Polypeptide |
|---|---|---|---|
| 77 | S04360143 | SEQ ID NO: 454 | SEQ ID NO: 544 |
| 76 | S04360146 | SEQ ID NO: 455 | SEQ ID NO: 545 |
| 75 | S04360160 | SEQ ID NO: 456 | SEQ ID NO: 546 |
| 79 | S04360435 | SEQ ID NO: 457 | SEQ ID NO: 547 |
| 77 | S04360466 | SEQ ID NO: 458 | SEQ ID NO: 548 |
| 77 | S04360467 | SEQ ID NO: 459 | SEQ ID NO: 549 |
| 73 | S04360469 | SEQ ID NO: 460 | SEQ ID NO: 550 |
| 78 | S04360485 | SEQ ID NO: 461 | SEQ ID NO: 551 |
| 80 | S04360504 | SEQ ID NO: 462 | SEQ ID NO: 552 |
| 76 | S04360545 | SEQ ID NO: 463 | SEQ ID NO: 553 |
| 77 | S04360574 | SEQ ID NO: 464 | SEQ ID NO: 554 |
| 76 | S04360579 | SEQ ID NO: 465 | SEQ ID NO: 555 |
| 74 | S04360592 | SEQ ID NO: 466 | SEQ ID NO: 556 |
| 79 | S04360619 | SEQ ID NO: 467 | SEQ ID NO: 557 |
| 77 | S04360626 | SEQ ID NO: 468 | SEQ ID NO: 558 |
| 77 | S04360660 | SEQ ID NO: 469 | SEQ ID NO: 559 |
| 78 | S04360664 | SEQ ID NO: 470 | SEQ ID NO: 560 |
| 77 | S04360699 | SEQ ID NO: 471 | SEQ ID NO: 561 |
| 76 | S04360787 | SEQ ID NO: 472 | SEQ ID NO: 562 |
| 99 | S04363576 | SEQ ID NO: 473 | SEQ ID NO: 563 |
| 97 | S04363577 | SEQ ID NO: 474 | SEQ ID NO: 564 |
| 95 | S04363578 | SEQ ID NO: 475 | SEQ ID NO: 565 |
| 97 | S04363579 | SEQ ID NO: 476 | SEQ ID NO: 566 |
| 97 | S04363580 | SEQ ID NO: 477 | SEQ ID NO: 567 |
| 95 | S04363584 | SEQ ID NO: 478 | SEQ ID NO: 568 |
| 97 | S04363585 | SEQ ID NO: 479 | SEQ ID NO: 569 |
| 96 | S04363587 | SEQ ID NO: 480 | SEQ ID NO: 570 |
| 96 | S04363588 | SEQ ID NO: 481 | SEQ ID NO: 571 |
| 97 | S04363593 | SEQ ID NO: 482 | SEQ ID NO: 572 |
| 95 | S04363594 | SEQ ID NO: 483 | SEQ ID NO: 573 |
| 96 | S04363600 | SEQ ID NO: 484 | SEQ ID NO: 574 |
| 97 | S04363605 | SEQ ID NO: 485 | SEQ ID NO: 575 |
| 96 | S04363608 | SEQ ID NO: 486 | SEQ ID NO: 576 |
| 96 | S04363609 | SEQ ID NO: 487 | SEQ ID NO: 577 |
| 97 | S04363612 | SEQ ID NO: 488 | SEQ ID NO: 578 |
| 94 | S04363619 | SEQ ID NO: 489 | SEQ ID NO: 579 |
| 97 | S04363623 | SEQ ID NO: 490 | SEQ ID NO: 580 |
| 94 | S04363625 | SEQ ID NO: 491 | SEQ ID NO: 581 |
| 93 | S04363626 | SEQ ID NO: 492 | SEQ ID NO: 582 |
| 97 | S04363629 | SEQ ID NO: 493 | SEQ ID NO: 583 |
| 96 | S04363631 | SEQ ID NO: 494 | SEQ ID NO: 584 |
| 95 | S04363632 | SEQ ID NO: 495 | SEQ ID NO: 585 |
| 94 | S04363638 | SEQ ID NO: 496 | SEQ ID NO: 586 |
| 98 | S04363643 | SEQ ID NO: 497 | SEQ ID NO: 587 |
| 97 | S04363644 | SEQ ID NO: 498 | SEQ ID NO: 588 |
| 97 | S04363646 | SEQ ID NO: 499 | SEQ ID NO: 589 |
| 95 | S04363648 | SEQ ID NO: 500 | SEQ ID NO: 590 |
| 96 | S04363659 | SEQ ID NO: 501 | SEQ ID NO: 591 |
| 94 | S04363660 | SEQ ID NO: 502 | SEQ ID NO: 592 |
| 96 | S04363662 | SEQ ID NO: 503 | SEQ ID NO: 593 |
| 97 | S04363663 | SEQ ID NO: 504 | SEQ ID NO: 594 |
| 64 | S04367796 | SEQ ID NO: 505 | SEQ ID NO: 595 |
| 83 | S04367808 | SEQ ID NO: 506 | SEQ ID NO: 596 |
| 76 | S04367849 | SEQ ID NO: 507 | SEQ ID NO: 597 |
| 78 | S04367850 | SEQ ID NO: 508 | SEQ ID NO: 598 |
| 80 | S04367851 | SEQ ID NO: 509 | SEQ ID NO: 599 |
| 78 | S04367860 | SEQ ID NO: 510 | SEQ ID NO: 600 |
| 77 | S04367872 | SEQ ID NO: 511 | SEQ ID NO: 601 |
| 77 | S04367882 | SEQ ID NO: 512 | SEQ ID NO: 602 |
| 79 | S04367903 | SEQ ID NO: 513 | SEQ ID NO: 603 |
| 78 | S04367917 | SEQ ID NO: 514 | SEQ ID NO: 604 |
| 78 | S04367945 | SEQ ID NO: 515 | SEQ ID NO: 605 |
| 80 | S04367977 | SEQ ID NO: 516 | SEQ ID NO: 606 |
| 78 | S04367983 | SEQ ID NO: 517 | SEQ ID NO: 607 |
| 87 | S04371015 | SEQ ID NO: 718 | SEQ ID NO: 728 |
| 88 | S04371039 | SEQ ID NO: 719 | SEQ ID NO: 729 |
| 84 | S04371062 | SEQ ID NO: 720 | SEQ ID NO: 730 |
| 86 | S04371086 | SEQ ID NO: 721 | SEQ ID NO: 731 |
| 73 | S04382521 | SEQ ID NO: 722 | SEQ ID NO: 732 |
| 84 | S04382532 | SEQ ID NO: 723 | SEQ ID NO: 733 |
| 98 | S04382574 | SEQ ID NO: 724 | SEQ ID NO: 734 |
| 88 | S04382581 | SEQ ID NO: 725 | SEQ ID NO: 735 |
| 89 | S04382591 | SEQ ID NO: 726 | SEQ ID NO: 736 |
| 87 | S04382601 | SEQ ID NO: 727 | SEQ ID NO: 737 |

TABLE 25

| % Identity to PtIP-83Aa (SEQ ID NO: 1) | # variants | Variants |
|---|---|---|
| 99 | 1 | S04363576 |
| 98 | 2 | S04363643, S04382574 |
| 97 | 12 | S04363646, S04363629, S04363612, S04363663, S04363585, S04363580, S04363623, S04363579, S04363605, S04363644, S04363593, S04363577 |
| 96 | 8 | S04363662, S04363587, S04363631, S04363659, S04363608, S04363600, S04363588, S04363609 |
| 95 | 5 | S04363648, S04363632, S04363584, S04363594, S04363578 |
| 94 | 4 | S04363660, S04363619, S04363625, S04363638 |
| 93 | 3 | S04363626, S04360136, S04360141 |
| 89 | 1 | S04382591 |
| 88 | 2 | S04371039, S04382581 |
| 87 | 2 | S04371015, S04382601 |
| 86 | 1 | S04371086 |
| 84 | 2 | S04371062, S04382532 |
| 83 | 1 | S04367808 |
| 81 | 2 | S04359951, S04359991 |
| 80 | 4 | S04360504, S04367851, S04367977, S04359988 |
| 79 | 3 | S04367903, S04360435, S04360619 |
| 78 | 8 | S04367983, S04367945, S04367850, S04360485, S04367917, S04360664, S04360132, S04367860 |
| 77 | 14 | S04367872, S04360467, S04360119, S04367882, S04360104, S04360626, S04359902, S04360143, S04359911, S04360034, S04360660, S04360574, S04360466, S04360699 |
| 76 | 9 | S04359909, S04360787, S04359888, S04359885, S04360579, S04360146, S04360059, S04367849, S04360545 |
| 75 | 3 | S04359942, S04360130, S04360160 |
| 74 | 3 | S04360592, S04360110, S04359944 |
| 73 | 9 | S04359896, S04360122, S04360469, S04360087, S04359899, S04360064, S04360095, S04359948, S04382521 |
| 64 | 1 | S04367796 |

The above description of various illustrated embodiments of the disclosure is not intended to be exhaustive or to limit the scope to the precise form disclosed. While specific embodiments of and examples are described herein for illustrative purposes, various equivalent modifications are possible within the scope of the disclosure, as those skilled in the relevant art will recognize. The teachings provided herein can be applied to other purposes, other than the examples described above. Numerous modifications and variations are possible in light of the above teachings and, therefore, are within the scope of the appended claims.

These and other changes may be made in light of the above detailed description. In general, in the following claims, the terms used should not be construed to limit the scope to the specific embodiments disclosed in the specification and the claims.

The entire disclosure of each document cited (including patents, patent applications, journal articles, abstracts, manuals, books or other disclosures) in the Background, Detailed Description, and Examples is herein incorporated by reference in their entireties.

Efforts have been made to ensure accuracy with respect to the numbers used (e.g. amounts, temperature, concentrations, etc.) but some experimental errors and deviations should be allowed for. Unless otherwise indicated, parts are parts by weight, molecular weight is average molecular weight; temperature is in degrees centigrade; and pressure is at or near atmospheric.

SEQUENCE LISTING (888 sequences)

SEQ ID NO: 1 - protein, 867 aa, Adiantum pedatum
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 2 - DNA, 2601 bp, Adiantum pedatum
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 3 - protein, 886 aa, Microsorum musifolium
MEYSSLYGDVNQVSLRFQNMEFSEVMVVHRMHVRLEELDMTGVEGIEKVKRLYVLADVVELPSTATQVFQYLRLPASISAIILCRVLYIPEVDQRPHMAQCSLDFPFMRLHVVGSVHENVGGVMQAFSSDATPSNIGIYLHADRFIYRQATSPASNFVLPLDVRVSFGSSTYSGPTIRPDWQNLNVSNISYGPQHLSKGPPLTSSDSDLQRSDEIELLAQQDVWSPLLHVAFSPTALPGNIPGTQGLFRPSSACSFFHVPPPDVPANVLTDPSIILGMQMNMLIAELVLAAHNSPQVMNVITKHVLWLNKILLQVASPNDDILALLFRIQAFMKMAKQPRFVVPRLQYHMYGSLINRMVQVAQNYDQEFKQLKLFIAQNEILGSYLLQQNRAFAEREKEMSAFHSQVVSMRRSELQSAIQTMDNLSLQMESESEAMNEAQENMVEAIQEYERKLLARALFSVIGAIASVALAFATGGATAPGAVAAAGGAVAAAGRLAAGLQKVVDILQGLQAVMEVVVAIRDIVESLKNMGQLVEAPEMPEMPTDADWLIFVNEVEAVAEQVPTEVAEVPVWKAKCKNVAVLGQAMCTTAAYISELQYQITVEKMLQEIAQRQADRLVGISAADLSSYTEMASQIDMRTTRILLELIKMLYIQNAAIKYEYLYDANEKLNSWPVSMETVWTMLLQQENAALLGLLDLGPTNDFTVTYAVKDIPTKLLVDGFDWNFEIAVEDSAIFPSGWSRVRIRYVELKFDQQGADSSNIVIHQPSTNTGLVYMLLQGSRFLHDRKHEEVMDYEASLGPVYAYAYDLNTGATTLNNIPSQQYANTFMQMTPFNAWRLRLSASAVENQGLVFPTATSPDNTTQISITFYVTAIRRIDHRQEGDVE

SEQ ID NO: 4 - DNA, 2658 bp, Microsorum musifolium
atggaatatagcagcttgtacggtgatgtgaaccaagtgagcctgaggttccagaacatggagttctctgaggtcatggtggtgcatcggatgcatgtgcgcctcgaggagcttgacatgacgggggtggagggcatcgagaaggtgaaacgcctgtacgtgctggcggacgtggtggagctgccttccacagccacccaggtgtttcagtatctgcgccttcctgcctccatttcagcgattatcctctgccgtgttctctatatccctgaagttgatcagaggccccacatggctcaatgctcgctcgacttcccgttcatgcgcctccatgtcgtcggatctgtacacgagaatgttgggggtgttatgcaagccttttcctccgacgccacccccagcaatattggcatctacctccatgctgaccgcttcatctaccgccaggccacatctccggccagcaactttgtcttgcccctggatgtaagggtcagctttggcagctctacctactcgggcccaaccatccgtcccgactggcaaaaccttaatgtctccaacatcagctacgggccacagcatttgtccaagggcccacccctcacatcctcagactccgacttgcagagatctgacgagatcgagctcctggcgcagcaagatgtttggagccctcttttacatgtcgcgtttagcccgactgcactacctggcaacatcccgggtacacaaggactattccgaccctcctctgcatgcagcttcttccatgtgccgccaccggatgtccctgcgaacgtgctcactgatccttccatcatcttgggcatgcaaatgaacatgctcattgccgagcttgtcttggctgctcacaattcgccgcaggtcatgaacgtcatcactaagcatgtgctatggctcaacaagatcttgcttcaggttgcttcacccaatgatgatattttagcactcttgtttcgtatccaagcattcatgaagatggcaaagcaaccgcggtttgtggttccacggttgcagtaccacatgtacggtagccttatcaatcgaatggtgcaagtagcccagaattatgaccaggagttcaagcaactcaagcttttcatcgcacaaaatgagattttgggaagctatttgctacaacaaaatagggcttttgcagaaagggagaaggaaatgagtgcttttcactcgcaggtcgtgtcgatgaggagatctgagcttcagtctgccatacaaacaatggacaatttgagtttgcaaatggaatcagagagtgaggcgatgaacgaagcccaggagaacatggttgaagcaattcaagagtatgaaaggaaattacttgcaagagctctattttctgtgattggggcaatagcaagcgttgctcttgcatttgccactggtggtgcaactgcaccgggggcagtggcagcagccggaggggctgttgctgcagcagggaggttggcagcagggctccaaaaggttgtggacatcctacaaggcttgcaagcggtcatggaggttgtggtagccataagagacatcgtagaatcattgaaaaacatgggtcaactagtagaagctcccgagatgccagagatgccaacggatgcggactggttaatttttgtaaatgaggtggaggcagtggcagagcaagtgccaacagaagtggcagaggtcccagtgtggaaggctaagtgcaagaatgtggctgtgctagggcaagcaatgtgcaccacagcagcatatattagtgagctacagtatcagatcacggtggaaaagatgctacaagagattgcacagcgccaagcagacaggttggtggggatatcagcagcagatctatcgagctacacagagatggcatcacaaatagacatgcgtacaacccgaatcctccttgaactcatcaagatgttgtacattcaaaatgcagcaattaagtatgagtacttgtatgatgctaatgagaagcttaattcatggccagtgagcatggagactgtatggaccatgctcttgcaacaagagaatgcagctctcttgggcttgctagacttggggcccaccaatgatttcactgtaacctatgctgttaaagacatacctaccaagttgttagtagatgggtttgattggaattttgagatcgcggtggaggattctgcaatctttccatcaggatggtctcgtgttcgcatacgatatgttgagcttaaatttgaccaacaaggtgctgatagtagtaacattgtcatccaccagcctagcactaacactggcttagtctacatgctcttacaaggctcccggttcctccatgaccgcaaacatgaggaggtgatggactatgaggcaagcttgggacctgtatatgcatatgcttatgacctcaacactggtgcaaccactctcaacaacatcccctcacagcaatatgccaacacatttatgcaaatgacacccttcaacgcctggagacttcgcctctctgcctctgctgtggaaaatcagggattggtgtttcctacagcaacttctcctgacaatactacccaaatttccatcacattctatgtcactgctattcgacgcatagatcatcgacaagagggtgatgtggag

SEQ ID NO: 5 - protein, 853 aa, Adiantum trapeziforme
MDYSTLYRDLNQISIGVDRVEFSEVMVIHRMYVRLSDLNVGELPGAGRVKRVYVFADVVELAPRATLRDQMHMPGSVTVIVLCRLLQFPIDGSQATTLRLPFMQLHARVIEQNVKSEITATDGMNWGIYIYGEKVERSPLLPSNAILAVWADRCTITSARHNHVNAPGRIISTFTLGSGVTGITSMHGEPSLDPWNGVSLDSASPTAFSALPRQSRNISFTSIPVEVVTDPSILLGMQTTVLIAELVKVCRPPSPDMMSAVAEHALWLNDVLLQVVQNESQLQGTAPYNECLALLGRIECVMKIGRFVSVVPQLQYRMYGNLIKQMAQVAQNYDQEFKQFKLFIVQNQILGSYLLQKNKALADRELQMESFHSAVISQRRQELNTAIAKMERMSLQMEEENRAMEQAQKEMEEGLREFQNRQVARAVFAVLKAVAMIALVFVTAGATAPGAAASAGQAVSIAGQAAQALRRVVEILEGLEAVMEVVAAVKDLVDSLEQVGQIVGAPEMPDMPSEADWSIFVNEIEAVAEGMPTEVSEVPAWKAKCKNMAALGREMSITAVQISELQYEIWVQGLMRDIARSHADRLAAIQPVDLTNHLEMATHMDMRTTSMLIGLLNMLRIQNAALMYEYLLTPTELTVWPLGMDTVANLLIAQENAALVGLIQLGQSSNFTSRHVVKGIPVSLLLDGEDWEFEIPVQAGMSSFPFNWTRVRIRHLEMQFAQEASGGGGGEIIHQPSTRSGIVYILLQGSTIFHDRRRDEVMTFQAADPLNFQYAYRLDTGEATLTNEPSEDFANTFMQMTPFTRWRLRLSASASENAELAFPTATAPDSTTEVVITFHVTAIRQVDWRQEEE

SEQ ID NO: 6 - DNA, 2559 bp, Adiantum trapeziforme
atggattacagcacgctttacagggacctgaaccagataagcatcggtgtggaccgggtagagttctcagaggtgatggtgatccacaggatgtatgtaaggttgtctgatctgaatgtgggggagctccccggagccgggagagtgaagcgggtgtacgtgtttgcggatgtggtggagcttgcaccgcgtgcgacgctgcgggatcagatgcatatgccaggatcggtgacagtgatcgtattgtgtcgtcttcttcaatttccaatcgatgggtcgcaagctacaactctccggctgcctttcatgcagttgcatgccagagtcatagagcaaaatgtaaagtcggagataacagcaacagatggcatgaattggggaatctacatatacggggagaaagtagagaggagcccgctccttcctagcaatgcaatccttgcagtttgggcagatcgctgtactataacctcagcccgtcacaatcatgttaacgcacctgggagaataatatcgactttcacacttgggtcgggagtaacgggtataacctctatgcacggggaacccagtttggacccttggaatggtgtttctctcgactcagcttcccctacggcatttagtgctttacctcgccaaagtaggaatatatccttcacaagtattccagtagaggtggtgactgatcctagcatcttgctgggcatgcagaccaccgtgctcattgcggagctagtcaaggtatgtcgcccaccatcacccgacatgatgagtgctgtagcggagcacgcgctttggctcaatgatgtcttactccaagttgtccagaacgaatctcagttgcaagggactgcgccctacaacgagtgccttgcacttttgggtcgcattgaatgtgtgatgaaaatcgggagatttgtctcagtagtgcctcagctgcaatacagaatgtatggtaacctcatcaaacaaatggcccaagtagcacaaaactacgaccaagaattcaagcaattcaagttattcatcgtccaaaaccaaatccttggcagctatttgcttcagaagaacaaggcattagctgacagggagctgcagatggagagctttcattcagcggtcatttctcaaagaaggcaggagttgaatactgccatcgcaaagatggagcgaatgagcttgcaaatggaggaagagaatagagcaatggagcaagctcaaaaggaaatggaagaaggattgagggagttccagaataggcaagttgcaagggccgtatttgccgttcttaaagccgtagctatgattgcgcttgtattcgtcacggctggtgcgacggctcctggagctgcggcgtccgcggggcaagctgtgagcatagcaggtcaggccgcacaagctctgcgaagggtggtggaaattctagaggggctggaggctgtgatggaggttgtggctgctgtgaaggaccttgtggattcattggaacaggtaggtcagattgtgggggcaccggagatgccggacatgccctcggaggcggactggtccatttttgtgaatgagattgaggccgtggcagaggggatgccgacggaagtctcggaggttccggcatggaaggccaagtgcaagaatatggctgcactgggtagggagatgagcatcacggcagtacagatttctgagctccagtatgagatctgggtgcaaggcttgatgcgggatatagctcgaagccatgcagacaggttggctgcgattcaacctgtggaccttaccaaccatttggagatggccacacacatggatatgcggactacaagtatgctgatagggctcctcaacatgctgcgcatccagaatgcggcactcatgtacgagtaccttctaacacccacggagctcacagtatggccactgggtatggataccgtggccaacttgctcattgcgcaggagaatgctgcactggtgggattaattcagctagggcaatcgtcgaattttacgagcagacatgtggtgaaaggcatacctgtgagcttactgctcgatggtgaggattgggaattcgagatccctgtgcaagctggcatgtccagcttccctttcaactggactcgggtcaggattcggcacctggagatgcaatttgcgcaggaggcgagtggtggtggtggtggcgagattatccaccagccttccacccggtcggggattgtttacatcctcctgcagggctccactatcttccatgaccgcagaagagatgaggtgatgacctttcaggcagcggacccgctcaacttccaatatgcgtaccgcctcgacactggcgaagccactctaacgaatgagccctcggaagactttgcgaacacgttcatgcagatgacacccttcactcgctggaggcttcgtctctctgcgtccgcctcagagaatgcagaattagcgtttccaacagctacagctcccgactccactaccgaggttgtcatcacgttccatgttacggcaattagacaagttgactggcggcaagaggaggag

SEQ ID NO: 7 - protein, 852 aa, Adiantum trapeziforme
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAIKHLVDALDQVSQIVDAPPMPDMPSEADWSIFVNEIEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 8 - DNA, 2556 bp, Adiantum trapeziforme
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 9 - protein, 851 aa, Adiantum trapeziforme
MDYSTLYRDLNQISIGVDRVEFSEVMVIHRMYVRLSDLNVGELPGAGRVKRVYVFADVVELAPRATLRDQMHMPGSVTVIVLCRLLQFPIDGSQATTLRLPFMQLHARVIEQNVKSEITATDGMNWGIYIYGEKVERSPLLPSNAILAVWADRCTITSARHNHVNAPGRIISTFTLGSGVTGITSMHGEPSLDPWNGVSLDSASPTAFSALPRQSRNISFTSIPVEVVTDPSILLGMQTTVLIAELVKVCRPPSPDMMSAVAEHALWLNDVLLQVVQKESQMQGTAPYNECLALLGRIECVMKIGRFVSVVPQLQYRMYGNLIKQMAQVAQNYDQEFKQFKLFIIQNQIFGSYLLQQNKAFADRELQMESFHSAVISQRRQELNTAIAKMERMSLQMEEENRAMEQAQKEMEEGLREFQNRQVARAVFAVLKAVAMIALAFVTAGATAPGAAASAGQAVSIAGQAAQALRRVVEILEGLEAVMEVVAAVKDLVDSLEQVGHIVGAPEMPDMPSEADWSIFVNEIEAVAEGMPTEVSEVPAWKAKCKNMAALGREMSITAVQISELQYEIWVQGLMRDIARSHADRLAAIQPVDLTNHLEMATHMDMRTTSMLIGLLNMLRIQNAALMYEYLLTPTELTVWPLGMDTVANLLIAQENAALVGLIQLGPSSNFTSRHVVKGIPVSLLLDGEDWEFEIPVQAGMSSFPFNWTRVRIRHLEMQFAQEASGGDEIIHQPSTRSGIVYILLQGSTIFHDRRRDEVMTFQAADPLNFQYAYRLDTGEATLTNEPSEEFANTFMQMTPFTRWRLRLSASASENAELAFPTATAPDSTTEVVITFHVTAIRQVDWRQEEE

SEQ ID NO: 10 - DNA, 2553 bp, Adiantum trapeziforme
atggattacagcacgctttacagggacctgaaccagataagcatcggtgtggaccgggtagagttctcagaggtgatggtgatccacaggatgtatgtaaggttgtctgatctgaatgtgggggagctccccggagccgggagagtgaagcgggtgtacgtgtttgcggatgtggtggagcttgcaccgcgtgcgacgctgcgggatcagatgcatatgccaggatcggtgacagtgatcgtattgtgtcgtcttcttcaatttccaatcgatgggtcgcaagctacaactctccggctgcctttcatgcagttgcatgccagagtcatagagcaaaatgtaaagtcggagataacagcaacagatggcatgaattggggaatctacatatacggggagaaagtagagaggagcccgctccttcctagcaatgcaatccttgcagtttgggcagatcgctgtactataacctcagcccgtcacaatcatgttaacgcacctgggagaataatatcgactttcacacttgggtcgggagtaacgggtataacctctatgcacggggaacccagtttggacccttggaatggtgtttctctcgactcagcttcccctacggcatttagtgctttacctcgccaaagtaggaatatatccttcacaagtattccagtagaggtggtgactgatcctagcatcttgctgggcatgcagaccaccgtgctaattgcggagctagtcaaggtatgtcgcccaccatcacccgacatgatgagtgctgtagcggagcacgcgctttggctcaatgatgtcttacttcaagttgtccagaaagaatcgcagatgcaagggactgcgccctacaacgagtgccttgcacttttgggtcgcattgaatgtgtgatgaaaatcgggagatttgtctcagtagtgcctcagctgcaatacagaatgtatggtaacctcatcaaacaaatggcccaagtagcacaaaactacgaccaagaattcaagcaattcaagttattcatcatccaaaaccaaatctttggcagctatttgcttcagcagaacaaggcatttgctgacagggagctgcagatggagagctttcattcagcggtcatttctcaaagaaggcaggagttgaatactgccatcgcaaagatggagcgaatgagcttgcaaatggaggaagagaatagagcaatggagcaagctcaaaaggaaatggaagaaggattgagggagttccagaataggcaagttgcaagggccgtatttgccgttcttaaagccgtagctatgattgcgcttgcattcgtcacggctggtgcgacggctcctggagctgcggcgtccgcggggcaagctgtgagcatagcaggtcaggccgcacaagctctgcgaagggtggtggaaattctagaggggctggaggctgtgatggaggttgtggctgctgtgaaggaccttgtggattcattggaacaggtaggtcacattgtgggggcaccggagatgccggacatgccctcggaggcggactggtccatttttgtgaatgagattgaggccgtggcagaggggatgccaacggaagtctcggaggttccggcatggaaggccaagtgcaagaatatggctgcactgggtagggagatgagcatcacggcagtacagatttctgagctccagtatgagatctgggtgcaaggcttgatgcgggatatagctcgaagccatgcagacaggttggctgcgattcaacctgtggaccttaccaaccatttggagatggccacacacatggatatgcggactacaagtatgctgatagggctcctcaatatgctgcgcatccagaatgcggcactcatgtacgagtaccttctaacacccacggagctcacagtatggccactgggtatggataccgtggccaacttgctcattgcgcaggagaatgctgcactggtgggattaattcagctagggccctcgtcgaattttacgagcagacatgtggtgaaaggcatacctgtgagcttgctgctcgatggtgaggattgggagttcgagatccctgtgcaagctggcatgtccagcttccctttcaactggactcgggtcaggattcggcacctggagatgcaatttgcgcaggaggcgagtggtggtgacgagattatccaccagccttccacccggtcggggattgtttacatcctcctgcagggctccactatcttccatgaccgcagaagagatgaggtgatgacctttcaggcagcggacccgctcaacttccaatatgcgtaccgcctcgacactggcgaagccactctaacgaatgagccctcggaagagtttgcgaacacgttcatgcagatgacacccttcactcgctggaggcttcgtctctctgcgtccgcctcagagaatgcagaattagcgtttccaacagctacagctcccgactccactaccgaggttgtcatcacgttccatgttacggcaatcagacaagttgactggcggcaagaggaggag

SEQ ID NO: 11 - protein, 851 aa, Adiantum trapeziforme
MDYSTLYRDLNQISIGVDRVEFSEVMVIHRMYVRLSDLNVGELPGAGRVKRVYVFADVVELAPRETLRDQMHMPGSVTVIILCRLLQFPIDGSQATTLRLPFMQLHARVIEQNVKSEITATDGMNWGIYIYGEKVERSPLLPSNAILAVWADRCTITSARHNHVNAPGRIISTFTLGSGVTGITSMHGEPSLDPWNGVSLDSASPTAFSALPRQSRNISFTSIPVEVVTDPSILLGMQTTVLIAELVKVCRPPSPDMMSAVAEHALWLNDVLLQVVQKESQMQGTAPYNECLALLGRIECVMKIGRFVSVVPQLQYRMYGNLIKQMAQVAQNYDQEFKQFKLFIIQNQIFGSYLLQQNKAFADRELQMESFHSAVISQRRQELNTAIAKMERMSLQMEEENRAMEQAQKEMEEGLREFQNRQVARAVFAVLKAVAMIALAFVTAGATAPGAAASAGQAVSIAGQAAQALRRVVEILEGLEAVMEVVAAVKDLVDSLEQVGHIVGAPEMPDMPSEADWSIFVNEIEAVAEGMPTEVSEVPAWKAKCKNMAALGREMSITAVQISELQYEIWVQGLMRDIARSHADRLAAIQPVDLTNHLEMATHMDMRTTSMLIGLLNMLRIQNAALMYEYLLTPTELTVWPLGMDTVANLLIAQENAALVGLIQLGPSSNFTSRHVVKGIPVSLLLDGEDWEFEIPVQAGMSSFPFNWTRVRIRHLEMQFAQEASGGDEIIHQPSTRSGIVYILLQGSTIFHDRRRDEVMTFQAADPLNFQYAYRLDTGEATLTNEPSEEFANTFMQMTPFTRWRLRLSASASENAELAFPTATAPDSTTEVVITFHVTAIRQVDWRQEEE

SEQ ID NO: 12 - DNA, 2553 bp, Adiantum trapeziforme
atggattacagcacgctttacagggacctgaaccagataagcatcggtgtggaccgggtagagttctcagaggtgatggtgatccacaggatgtatgtaaggttgtctgatctgaatgtgggggagctccccggagccgggagagtgaagcgggtgtacgtgtttgcggatgtggtggagcttgcaccgcgcgagacgctgcgggaccagatgcatatgccaggatcggtgacagtgatcatattgtgtcggcttcttcaatttccaatcgatgggtcgcaagctacaactctccggctgcctttcatgcagttgcatgccagagtcatagagcaaaatgtaaagtcggagataacagcaacagatggcatgaattggggaatctacatatacggggagaaagtagagaggagcccgctccttcctagcaatgcaatccttgcagtttgggcagatcgctgtactataacctcagcccgtcacaatcatgttaacgcacctgggagaataatatcgactttcacacttgggtcgggagtaacgggtataacctctatgcacggggaacccagtttggacccttggaatggtgtttctctcgactcagcttcccctacggcatttagtgctttacctcgccaaagtaggaatatatccttcacaagtattccagtagaggtggtgactgatcctagcatcttgctgggcatgcagaccaccgtgctaattgcggagctagtcaaggtatgtcgcccaccatcacccgacatgatgagtgctgtagcggagcacgcgctttggctcaatgatgtcttacttcaagttgtccagaaagaatcgcagatgcaagggactgcgccctacaacgagtgccttgcacttttgggtcgcattgaatgtgtgatgaaaatcgggagatttgtctcagtagtgcctcagctgcaatacagaatgtatggtaacctcatcaaacaaatggcccaagtagcacaaaactacgaccaagaattcaagcaattcaagttattcatcatccaaaaccaaatctttggcagctatttgcttcagcagaacaaggcatttgctgacagggagctgcagatggagagctttcattcagcggtcatttctcaaagaaggcaggagttgaatactgccatcgcaaagatggagcgaatgagcttgcaaatggaggaagagaatagagcaatggagcaagctcaaaaggaaatggaagaaggattgagggagttccagaataggcaagttgcaagggccgtatttgccgttcttaaagccgtagctatgattgcgcttgcattcgtcacggctggtgcgacggctcctggagctgcggcgtccgcggggcaagctgtgagcatagcaggtcaggccgcacaagctctgcgaagggtggtggaaattctagaggggctggaggctgtgatggaggttgtggctgctgtgaaggaccttgtggattcattggaacaggtaggtcacattgtgggggcaccggagatgccggacatgccctcggaggcggactggtccatttttgtgaatgagattgaggccgtggcagaggggatgccaacggaagtctcggaggttccggcatggaaggccaagtgcaagaatatggctgcactgggtagggagatgagcatcacggcagtacagatttctgagctccagtatgagatctgggtgcaaggcttgatgcgggatatagctcgaagccatgcagacaggttggctgcgattcaacctgtggaccttaccaaccatttggagatggccacacacatggatatgcggactacaagtatgctgatagggctcctcaatatgctgcgcatccagaatgcggcactcatgtacgagtaccttctaacacccacggagctcacagtatggccactgggtatggataccgtggccaacttgctcattgcgcaggagaatgctgcactggtgggattaattcagctagggccctcgtcgaattttacgagcagacatgtggtgaaaggcatacctgtgagcttgctgctcgatggtgaggattgggagttcgagatccctgtgcaagctggcatgtccagcttccctttcaactggactcgggtcaggattcggcacctggagatgcaatttgcgcaggaggcgagtggtggtgacgagattatccaccagccttccacccggtcggggattgtttacatcctcctgcagggctccactatcttccatgaccgcagaagagatgaggtgatgacctttcaggcagcggacccgctcaacttccaatatgcgtaccgcctcgacactggcgaagccactctaacgaatgagccctcggaagagtttgcgaacacgttcatgcagatgacacccttcactcgctggaggcttcgtctctctgcgtccgcctcagagaatgcagaattagcgtttccaacagctacagctcccgactccactaccgaggttgtcatcacgttccatgttacggcaatcagacaagttgactggcggcaagaggaggag

SEQ ID NO: 13 - protein, 854 aa, Adiantum peruvianum
MDYSTLYRDLNQISIGVDRVEFSEVMVIHRMYVRLSDLNVGELPGAGRVKRVYVFADVVELAPRATLRDQMHMPGSVTVIVLCRLLQFPIDGSQATTLRLPFMQLHARVIEQNVKSEITATDGMNWGIYIYGEKVERSPLLPSNAILAVWADRCTITSARHNHVNAPGRIISTFTLGSGVTGITSMHGEPSLDPWNGVSLDSASPTAFSALPRQSRNISFTSIPVEVVTDPSILLGMQTTVLIAELVKVCRPPSPDMMSAVAEHALWLNDVLLQVVQKESQMQGTAPYNECLALLGRIECVMKIGRFVSVVPQLQYRMYGNLIKQMAQVAQNYDQEFKQFKLFIIQNQIFGSYLLQQNKAFADRELQMESFHSAVISQRRQELNTAIAKMERMSLQMEEENRAMEQAQKEMEEGLREFQNRQVARAVFAVLKAVAMIALAFVTAGATAPGAAASAGQAVSIAGQAAQALRRVVEILEGLEAVMEVVAAVKDLVDSLEQVGHIVGAPEMPDMPSEADWSIFVNEIEAVAEGMPTEVSEVPAWKAKCKNMAALGREMSITAVQISELQYEIWVQGLMRDIARSHADRLAAIQPVDLTNHLEMATHMDMRTTSMLIGLLNMLRIQNAALMYEYLLTPTELTVWPLGMDTVANLLIAQENAALVGLIQLGPSSNFTSRHVVKGIPVSLLLDGEDWEFEIPVQAGMSSFPFNWTRVRIRHLEMQFAQEASGGDEIIHQPSTRSGIVYILLQGSTIFHDRRRDEVMTFQAADPLNFQYAYRLDTGEATLTNEPSEEFANTFMQMTPFTRWRLRLSASASENAELAFPTATAPDSTTEVVITFHVTAIRQVDWRQEEKEEE

SEQ ID NO: 14 - DNA, 2562 bp, Adiantum peruvianum
atggattacagcacgctttacagggacctgaaccagataagcatcggtgtggaccgggtagagttctcagaggtgatggtgatccacaggatgtatgtaaggttgtctgatctgaatgtgggggagctccccggagccgggagagtgaagcgggtgtacgtgtttgcggatgtggtggagcttgcaccgcgtgcgacgctgcgggatcagatgcatatgccaggatcggtgacagtgatcgtattgtgtcgtcttcttcaatttccaatcgatgggtcgcaagctacaactctccggctgcctttcatgcagttgcatgccagagtcatagagcaaaatgtaaagtcggagataacagcaacagatggcatgaattggggaatctacatatacggggagaaagtagagaggagcccgctccttcctagcaatgcaatccttgcagtttgggcagatcgctgtactataacctcagcccgtcacaatcatgttaacgcacctgggagaataatatcgactttcacacttgggtcgggagtaacgggtataacctctatgcacggggaacccagtttggacccttggaatggtgtttctctcgactcagcttcccctacggcatttagtgctttacctcgccaaagtaggaatatatccttcacaagtattccagtagaggtggtgactgatcctagcatcttgctgggcatgcagaccaccgtgctaattgcggagctagtcaaggtatgtcgcccaccatcacccgacatgatgagtgctgtagcggagcacgcgctttggctcaatgatgtcttacttcaagttgtccagaaagaatcgcagatgcaagggactgcgccctacaacgagtgccttgcacttttgggtcgcattgaatgtgtgatgaaaatcgggagatttgtctcagtagtgcctcagctgcaatacagaatgtatggtaacctcatcaaacaaatggcccaagtagcacaaaactacgaccaagaattcaagcaattcaagttattcatcatccaaaaccaaatctttggcagctatttgcttcagcagaacaaggcatttgctgacagggagctgcagatggagagctttcattcagcggtcatttctcaaagaaggcaggagttgaatactgccatcgcaaagatggagcgaatgagcttgcaaatggaggaagagaatagagcaatggagcaagctcaaaaggaaatggaagaaggattgagggagttccagaataggcaagttgcaagggccgtatttgccgttcttaaagccgtagctatgattgcgcttgcattcgtcacggctggtgcgacggctcctggagctgcggcgtccgcggggcaagctgtgagcatagcaggtcaggccgcacaagctctgcgaagggtggtggaaattctagaggggctggaggctgtgatggaggttgtggctgctgtgaaggaccttgtggattcattggaacaggtaggtcacattgtgggggcaccggagatgccggacatgccctcggaggcggactggtccatttttgtgaatgagattgaggccgtggcagaggggatgccaacggaagtctcggaggttccggcatggaaggccaagtgcaagaatatggctgcactgggtagggagatgagcatcacggcagtacagatttctgagctccagtatgagatctgggtgcaaggcttgatgcgggatatagctcgaagccatgcagacaggttggctgcgattcaacctgtggaccttaccaaccatttggagatggccacacacatggatatgcggactacaagtatgctgatagggctcctcaatatgctgcgcatccagaatgcggcactcatgtacgagtaccttctaacacccacggagctcacagtatggccactgggtatggataccgtggccaacttgctcattgcgcaggagaatgctgcactggtgggattaattcagctagggccctcgtcgaattttacgagcagacatgtggtgaaaggcatacctgtgagcttgctgctcgatggtgaggattgggagttcgagatccctgtgcaagctggcatgtccagcttccctttcaactggactcgggtcaggattcggcacctggagatgcaatttgcgcaggaggcgagtggtggtgacgagattatccaccagccttccacccggtcggggattgtttacatcctcctgcagggctccactatcttccatgaccgcagaagagatgaggtgatgacctttcaggcagcggacccgctcaacttccaatatgcgtaccgcctcgacactggcgaagccactctaacgaatgagccctcggaagagtttgcgaacacgttcatgcagatgacacccttcactcgctggaggcttcgtctctctgcgtccgcctcagagaatgcagaattagcgtttccaacagctacagctcccgactccactaccgaggttgtcatcacgttccatgttacggcaatcagacaagttgactggcggcaggaggagaaagaggaggag

SEQ ID NO: 15 - protein, 852 aa, Lygodium flexuosum
MASVLDYSTLYRDLNQISMAVDQVEFSEVMVIHRMYVNLADLDVAELVGAETVKRVYVFADVVELAPGKRTQLPGSVTVIILCRLLQFPTGGSRAATLQLPFMKVHATLIERFRSEIAAADGMNWGTYIHGEEVQVSPLYPNNSILGVWADRSIITSAFHNVFDEPGRVISSTSITRAQSAPNNTTMSAEPGWLSGNRFLLYTVSRSAFSVLPSQSTNVSFTSIPVEVVTDPNILLGMQTTVHIAELVKAGHPSPDIVSAVAEHAIWLSKVLLQVVQNESHLQGTESYNECLALLGRVQSVIKMGRFGLVVPQLQYRMYGSLIKQMAQVAQNYDQDFKRFRLFILQNQILGSYLLEQNKAFADRELQMESFHSAVISQRKGELDTAFAKMDRLSLQMEEENGAMEQAQKEMDEGLRQFQNRQVARALFAVLRAVAQIGLAFVTAGATAPGAVASAGQAVSIAGQAAQGLRRVVEILEQLEAVMEVVAAVKDLVNSLEQVGQLVQAPVMPDMPSEADWSIFVNEVEAVAEGMPTEVSEVPAWKAKCKNVAALGREMSITAVQISELQYDIWVQGMMRDIAQSQADRLAAIQPADLTNFLEMATQMDMRTTRMLIGLLNMLRIQNAALMYEYLLTPTELTAWPLGMDTVGNLLIAQENAALLGLTQLGPSSDFTSRHVVKGIPVSLLLDGEDWEFEIPVQGGMSSFPSSWTRVRIRHLEMHFVQESMNGGGEIIHQPATQTGTVYILLQGSTIFHDRRRDEVMTFQAAAPLNYQYAYRLDTGETTLTNQPSEHFANTFMQMTPFTRWRLRLSASAPENAGLAFPTATALDSTTQIVITFHVTAIRQIDWRHEEE

SEQ ID NO: 16 - DNA, 2556 bp, Lygodium flexuosum
atggccagtgtactggattacagcacgctttacagggatctgaaccagataagcatggctgtggatcaggtagagttctcagaggtgatggtgatccacaggatgtatgtgaatttagctgacctggatgtggcggagctcgtgggagctgagacagtgaagcgggtgtatgtgtttgcggatgtggtggagcttgcaccggggaaacggacgcaattgccaggatcggtgacggtgatcatattgtgtcgtcttcttcaatttccaactggtgggtcgcgagcagcaactctccagctgcctttcatgaaggtccatgctacactcatagagcgatttaggtcagagatagcagcagcagatgggatgaactggggaacgtacatacacggggaggaagtacaggtcagcccgctgtatcctaacaattcaatacttggagtttgggcagatcgctctattataacctcagcctttcacaatgtgttcgacgaacctgggagagtaatttccagtactagtattacaagggcacagtcagcacccaacaacacgactatgtcagcagaacccggctggctctctggcaatcgttttctactttacacggtttcccggtcggcattcagtgttttacctagccaaagtacgaatgtatccttcacaagtattccggtagaggtggtgactgatccgaacatcttgctgggcatgcagacaacagtgcacattgcggagctagtcaaggcaggtcacccgtcacccgacattgtgagcgcggtagcggagcacgcgatttggctcagcaaagtcttgctccaagttgtgcagaacgaatctcacttgcaagggaccgagtcctacaacgagtgcctggcacttttgggccgtgttcaatctgtgatcaagatggggagatttggcttagtagtgccccagctgcaatacagaatgtacggtagcctcatcaaacaaatggcccaagtagcacagaactacgaccaagatttcaagcgattccggttattcattcttcaaaatcaaatccttggcagctatttgctggagcagaacaaggcatttgctgacagggagctgcagatggagagcttccattcagccgtgatttctcaaagaaaaggcgagctggacactgccttcgcaaagatggaccgactgagcttgcaaatggaggaagagaatggcgcaatggagcaagcccaaaaggaaatggacgaaggattaaggcagttccagaataggcaagttgcaagggccctctttgccgttcttagagctgtagctcagattgggcttgcattcgtcacggctggtgcaacggctcctggagctgtggcgtccgcggggcaagccgtgagcatagcaggtcaggccgcgcaaggtctgcgaagggtggtggaaatcctagagcagctggaagctgtgatggaggttgtggctgctgtgaaggaccttgtgaattcattggaacaggtaggtcagttggtgcaggcaccggtgatgccggacatgccctcggaagcggactggtccatttttgtgaatgaggtcgaggccgtggcagaggggatgccgacggaagtctcggaggttccagcgtggaaggccaagtgcaagaatgtggctgcactgggtcgggagatgagcatcaccgcagtacaaatttctgagctccagtatgacatctgggtgcaaggcatgatgcgggatattgctcaaagccaggcagacaggctggcggcgattcaacccgcggaccttaccaactttttggagatggcaacacagatggatatgcggactacaaggatgctgatagggctcctcaacatgctccgcatccagaatgcggcactcatgtacgagtaccttcttacgcccacggagctcacagcatggccgctgggtatggataccgtgggcaacttgctcattgcgcaggagaatgctgcactattaggattaactcagctaggaccctcatccgatttcacgagcaggcatgtggtgaaaggcatacctgtgagcttgctactcgatggtgaggattgggagttcgagatccctgtgcaaggtggcatgtccagcttcccttcaagctggactcgcgtccggattcggcacttggagatgcactttgtgcaagagtcgatgaacggtggcggcgagattattcaccagcctgccacccagactgggaccgtttacatcctcctgcagggctccactatcttccatgaccgcagaagagacgaggtgatgacctttcaggcagcggctccgctcaactaccagtacgcgtaccgcctcgacactggtgaaaccactcttacgaaccagccctcggaacactttgccaacacgttcatgcagatgacacccttcactcgctggaggcttcgtctctctgcgtccgccccagagaatgcaggattagcctttcccacagctacagctctcgactccactacccagattgtcatcactttccatgttacggccattagacaaattgactggcggcacgaggaggag

SEQ ID NO: 17 - protein, 852 aa, Adiantum peruvianum
MDYSTLYRDLNQISMPLDRVEFSEVMVIHRMYLRLSDLNVGELPGAERVKRLYVFADVVELATFAYPQLLHTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSVTQFTTDQSGRVDTTLLARTEFGHIYLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDALAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAIKHLVDALDQVSQIVDAPPMPDMPSEADWSIFVNEIEAVAEGMPTEVSEVPAWKAKCKNVAALGREMCITAEQISQLQYDIWVQGLLRDIAQTHADRLAAIQPANLTNYLEMATQMDMRTTRILIGLLNIMRIQNAALMYEYLLTPTQLTAWPLRMDTVANLLITQESAALSGLAQLGPPSDFTSRHVVKGIPVSLLLDGGDWEFEIPVQGGMSSFPSSWTRVRIRHLEMHFVQEASGGGEIIHQPATQTGTVYILLQGSTVFHDRRREEVMTFQAAVPLNYHYAYRLDTGEATLTNEPSEQFANTFMQMTPFTHWRLRLSASAAENEGLAFPTATAPDSTTEIAITFHVMAIRQIDWRQEEE

SEQ ID NO: 18 - DNA, 2556 bp, Adiantum peruvianum
atggattacagcactctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgtttgcagacgtggtggagctcgcgacatttgcgtatccacagttgcttcatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccgttactcaatttacaactgatcagtccggtcgggtagataccacactgctcgcacgaacagaattcggccatatttatctaccactcgagacagattccccaacggcattcagtgtttcacaccgccaaagtacgaatttgcccgtagagtacaccggtattccagtagaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttgggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcatttgctgacagagaggtgcagatggagagctttcattcagcggtcatttctcaaagaaggcaggagttggacgacgccctcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatccgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccacctatgccagacatgccctcggaggcagactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaacccacgcagaccggctggcagcgattcaacctgctaatcttaccaactatttggagatggcaacacagatggatatgcggactacgaggatattgatagggctcctcaacataatgcgcatccagaatgcggcacttatgtatgagtaccttctaacgcccacgcagctcactgcatggccgctgagaatggatactgtggccaacttgctcatcacgcaggagagtgctgcactgtcaggattagctcagttagggcccccatcggacttcacgagcaggcatgtggtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccgtttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaatgaaggattagcctttcccacagctacagctcccgactccaccactgagattgccatcactttccatgttatggccattagacaaatcgactggcggcaagaggaggag

SEQ ID NO: 19 - protein, 782 aa, Adiantum peruvianum
MDYSTLYRDLNQISIGVDRVEFSEVMVIHRMYVRLSDLNVGELPGAGRVKRVYVFADVVELAPRATLRDQMHMPGSVTVIVLCRLLQFPIDGSQATTLRLPFMQLHARVIEQNVKSEITATDGMNWGIYIYGEKVERSPLLPSNAILAVWADRCTITSARHNHVNAPGRIISTFTLGSGVTGITSMHGEPSLDPWNGVSLDSASPTAFSALPRQSRNISFTSIPVEVVTDPSILLGMQTTVLIAELVKVCRPPSPDMMSAVAEHALWLNDVLLQVVQKESQMQGTAPYNECLALLGRIECVMKIGRFVSVVPQLQYRMYGNLIKQMAQVAQNYDQEFKQFKLFIIQNQIFGSYLLQQNKAFADRELQMESFHSAVISQRRQELNTAIAKMERMSLQMEEENRAMEQAQKEMEEGLREFQNRQVARAVFAVLKAVAMIALAFVTAGATAPGAAASAGQAVSIAGQAAQALRRVVEILEGLEAVMEVVAAVKDLVDSLEQVGHIVGAPEMPDMPSEADWSIFVNEIEAVAEGMPTEVSEVPAWKAKCKNMAALGREMSITAVQISELQYEIWVQGLMRDIARSHADRLAAIQPVDLTNHLEMATHMDMRTTSMLIGLLNMLRIQNAALMYEYLLTPTELTVWPLGMDTVANLLIAQENAALVGLIQLGPSSNFTSRHVVKGIPVSLLLDGEDWEFEIPVQAGMSSFPFNWTRVRIRHLEMQFAQEASGGDEIIHQPSTRSGIVYILLQGSTIFHDRRRDEVMTFQAADPLNFQMRTASTLAKPL

SEQ ID NO: 20 - DNA, 2346 bp, Adiantum peruvianum
atggattacagcacgctttacagggacctgaaccagataagcatcggtgtggaccgggtagagttctcagaggtgatggtgatccacaggatgtatgtaaggttgtctgatctgaatgtgggggagctccccggagccgggagagtgaagcgggtgtacgtgtttgcggatgtggtggagcttgcaccgcgtgcgacgctgcgggatcagatgcatatgccaggatcggtgacagtgatcgtattgtgtcgtcttcttcaatttccaatcgatgggtcgcaagctacaactctccggctgcctttcatgcagttgcatgccagagtcatagagcaaaatgtaaagtcggagataacagcaacagatggcatgaattggggaatctacatatacggggagaaagtagagaggagcccgctccttcctagcaatgcaatccttgcagtttgggcagatcgctgtactataacctcagcccgtcacaatcatgttaacgcacctgggagaataatatcgactttcacacttgggtcgggagtaacgggtataacctctatgcacggggaacccagtttggacccttggaatggtgtttctctcgactcagcttcccctacggcatttagtgctttacctcgccaaagtaggaatatatccttcacaagtattccagtagaggtggtgactgatcctagcatcttgctgggcatgcagaccaccgtgctaattgcggagctagtcaaggtatgtcgcccaccatcacccgacatgatgagtgctgtagcggagcacgcgctttggctcaatgatgtcttacttcaagttgtccagaaagaatcgcagatgcaagggactgcgccctacaacgagtgccttgcacttttgggtcgcattgaatgtgtgatgaaaatcgggagatttgtctcagtagtgcctcagctgcaatacagaatgtatggtaacctcatcaaacaaatggcccaagtagcacaaaactacgaccaagaattcaagcaattcaagttattcatcatccaaaaccaaatctttggcagctatttgcttcagcagaacaaggcatttgctgacagggagctgcagatggagagctttcattcagcggtcatttctcaaagaaggcaggagttgaatactgccatcgcaaagatggagcgaatgagcttgcaaatggaggaagagaatagagcaatggagcaagctcaaaaggaaatggaagaaggattgagggagttccagaataggcaagttgcaagggccgtatttgccgttcttaaagccgtagctatgattgcgcttgcattcgtcacggctggtgcgacggctcctggagctgcggcgtccgcggggcaagctgtgagcatagcaggtcaggccgcacaagctctgcgaagggtggtggaaattctagaggggctggaggctgtgatggaggttgtggctgctgtgaaggaccttgtggattcattggaacaggtaggtcacattgtgggggcaccggagatgccggacatgccctcggaggcggactggtccatttttgtgaatgagattgaggccgtggcagaggggatgccaacggaagtctcggaggttccggcatggaaggccaagtgcaagaatatggctgcactgggtagggagatgagcatcacggcagtacagatttctgagctccagtatgagatctgggtgcaaggcttgatgcgggatatagctcgaagccatgcagacaggttggctgcgattcaacctgtggaccttaccaaccatttggagatggccacacacatggatatgcggactacaagtatgctgatagggctcctcaatatgctgcgcatccagaatgcggcactcatgtacgagtaccttctaacacccacggagctcacagtatggccactgggtatggataccgtggccaacttgctcattgcgcaggagaatgctgcactggtgggattaattcagctagggccctcgtcgaattttacgagcagacatgtggtgaaaggcatacctgtgagcttgctgctcgatggtgaggattgggagttcgagatccctgtgcaagctggcatgtccagcttccctttcaactggactcgggtcaggattcggcacctggagatgcaatttgcgcaggaggcgagtggtggtgacgagattatccaccagccttccacccggtcggggattgtttacatcctcctgcagggctccactatcttccatgaccgcagaagagatgaggtgatgacctttcaggcagcggacccgctcaacttccaaatgcgtaccgcctcgacactggcgaagccactc

SEQ ID NO: 21 - protein, 623 aa, Adiantum trapeziforme
MDYSTLYRDLNQISIGVDRVEFSPDMMSAVAEHALWLNDVLLQVVQKESQMQGTAPYNECLALLGRIECVMKIGRFVSVVPQLQYRMYGNLIKQMAQVAQNYDQEFKQFKLFIIQNQIFGSYLLQQNKAFADRELQMESFHSAVISQRRQELNTAIAKMERMSLQMEEENRAMEQAQKEMEEGLREFQNRQVARAVFAVLKAVAMIALAFVTAGATAPGAAASAGQAVSIAGQAAQALRRVVEILEGLEAVMEVVAAVKDLVDSLEQVGHIVGAPEMPDMPSEADWSIFVNEIEAVAEGMPTEVSEVPAWKAKCKNMAALGREMSITAVQISELQYEIWVQGLMRDIARSHADRLAAIQPVDLTNHLEMATHMDMRTTSMLIGLLNMLRIQNAALMYEYLLTPTELTVWPLGMDTVANLLIAQENAALVGLIQLGPSSNFTSRHVVKGIPVSLLLDGEDWEFEIPVQAGMSSFPFNWTRVRIRHLEMQFAQEASGGDEIIHQPSTRSGIVYILLQGSTIFHDRRRDEVMTFQAADPLNFQYAYRLDTGEATLTNEPSEEFANTFMQMTPFTRWRLRLSASASENAELAFPTATAPDSTTEVVITFHVTAIRQVDWRQEEKEEE

SEQ ID NO: 22 - DNA, 1869 bp, Adiantum trapeziforme
atggattacagcacgctttacagggacctgaaccagataagcatcggtgtggaccgggtagagttctcacccgacatgatgagtgctgtagcggagcacgcgctttggctcaatgatgtcttacttcaagttgtccagaaagaatcgcagatgcaagggactgcgccctacaacgagtgccttgcacttttgggtcgcattgaatgtgtgatgaaaatcgggagatttgtctcagtagtgcctcagctgcaatacagaatgtatggtaacctcatcaaacaaatggcccaagtagcacaaaactacgaccaagaattcaagcaattcaagttattcatcatccaaaaccaaatctttggcagctatttgcttcagcagaacaaggcatttgctgacagggagctgcagatggagagctttcattcagcggtcatttctcaaagaaggcaggagttgaatactgccatcgcaaagatggagcgaatgagcttgcaaatggaggaagagaatagagcaatggagcaagctcaaaaggaaatggaagaaggattgagggagttccagaataggcaagttgcaagggccgtatttgccgttcttaaagccgtagctatgattgcgcttgcattcgtcacggctggtgcgacggctcctggagctgcggcgtccgcggggcaagctgtgagcatagcaggtcaggccgcacaagctctgcgaagggtggtggaaattctagaggggctggaggctgtgatggaggttgtggctgctgtgaaggaccttgtggattcattggaacaggtaggtcacattgtgggggcaccggagatgccggacatgccctcggaggcggactggtccatttttgtgaatgagattgaggccgtggcagaggggatgccaacggaagtctcggaggttccggcatggaaggccaagtgcaagaatatggctgcactgggtagagagatgagcatcacggcagtacagatttctgagctccagtatgagatctgggtgcaaggcttgatgcgggatatagctcgaagccatgcagacaggttggctgcgattcaacctgtggaccttaccaaccatttggagatggccacacacatggatatgcggactacaagtatgctgatagggctcctcaatatgctgcgcatccagaatgcggcactcatgtacgagtaccttctaacacccacggagctcacagtatggccactgggtatggataccgtggccaacttgctcattgcgcaggagaatgctgcactggtgggattaattcagctagggccctcgtcgaattttacgagcagacatgtggtgaaaggcatacctgtgagcttgctgctcgatggtgaggattgggagttcgagatccctgtgcaagctggcatgtccagcttccctttcaactggactcgggtcaggattcggcacctggagatgcaatttgcgcaggaggcgagtggtggtgacgagattatccaccagccttccacccggtcggggattgtttacatcctcctgcagggctccactatcttccatgaccgcagaagagatgaggtgatgacctttcaggcagcggacccgctcaacttccaatatgcgtaccgcctcgacactggcgaagccactctaacgaatgagccctcggaagagtttgcgaacacgttcatgcagatgacacccttcactcgctggaggcttcgtctctctgcgtccgcctcagagaatgcagaattagcgtttccaacagctacagctcccgactccactaccgaggttgtcatcacgttccatgttacggcaatcagacaagttgactggcggcaggaggagaaagaggaggag

SEQ ID NO: 23 - protein, 691 aa, Adiantum trapeziforme
MDYSTLYRDLNQISIGVDRVEFSEVMVIHRMYVRLSDLNVGELPGAGRVKRVYVFADVVELAPRATLRDQMHMPGSVTVIVLCRLLQFPIDGSQATTLRLPFMQLHARVIEQNVKSEITATDGMNWGIYIYGEKVERSPLLPSNAILAVWADRCTITSARHNHVNAPGRIISTFTLGSGVTGITSMHGEPSLDPWNGVSLDSASPTAFSALPRQSRNISFTSIPVEVVTDPSILLGMQTTVLIAELVKVCRPPSPDMMSAVAEHALWLNDVLLQVVQKESQMQGTAPYNECLALLGRIECVMKIGRFVSVVPQLQYRMYGNLIKQMAQVAQNYDQEFKQFKLFIIQNQIFGSYLLQQNKAFADRELQMESFHSAVISQRRQELNTAIAKMERMSLQMEEENRAMEQAQKEMEEGLREFQNRQVARAVFAVLKAVAMIALAFVTAGATAPGAAASAGQAVSIALMYEYLLTPTELTVWPLGMDTVANLLIAQENAALVGLIQLGPSSNFTSRHVVKGIPVSLLLDGEDWEFEIPVQAGMSSFPFNWTRVRIRHLEMQFAQEASGGDEIIHQPSTRSGIVYILLQGSTIFHDRRRDEVMTFQAADPLNFQYAYRLDTGEATLTNEPSEEFANTFMQMTPFTRWRLRLSASASENAELAFPTATAPDSTTEVVITFHVTAIRQVDWRQEEKEEE

SEQ ID NO: 24 - DNA, 2073 bp, Adiantum trapeziforme
atggattacagcacgctttacagggacctgaaccagataagcatcggtgtggaccgggtagagttctcagaggtgatggtgatccacaggatgtatgtaaggttgtctgatctgaatgtgggggagctccccggagccgggagagtgaagcgggtgtacgtgtttgcggatgtggtggagcttgcaccgcgtgcgacgctgcgggatcagatgcatatgccaggatcggtgacagtgatcgtattgtgtcgtcttcttcaatttccaatcgatgggtcgcaagctacaactctccggctgcctttcatgcagttgcatgccagagtcatagagcaaaatgtaaagtcggagataacagcaacagatggcatgaattggggaatctacatatacggggagaaagtagagaggagcccgctccttcctagcaatgcaatccttgcagtttgggcagatcgctgtactataacctcagcccgtcacaatcatgttaacgcacctgggagaataatatcgactttcacacttgggtcgggagtaacgggtataacctctatgcacggggaacccagtttggacccttggaatggtgtttctctcgactcagcttcccctacggcatttagtgctttacctcgccaaagtaggaatatatccttcacaagtattccagtagaggtggtgactgatcctagcatcttgctgggcatgcagaccaccgtgctaattgcggagctagtcaaggtatgtcgcccaccatcacccgacatgatgagtgctgtagcggagcacgcgctttggctcaatgatgtcttacttcaagttgtccagaaagaatcgcagatgcaagggactgcgccctacaacgagtgccttgcacttttgggtcgcattgaatgtgtgatgaaaatcgggagatttgtctcagtagtgcctcagctgcaatacagaatgtatggtaacctcatcaaacaaatggcccaagtagcacaaaactacgaccaagaattcaagcaattcaagttattcatcatccaaaaccaaatctttggcagctatttgcttcagcagaacaaggcatttgctgacagggagctgcagatggagagctttcattcagcggtcatttctcaaagaaggcaggagttgaatactgccatcgcaaagatggagcgaatgagcttgcaaatggaggaagagaatagagcaatggagcaagctcaaaaggaaatggaagaaggattgagggagttccagaataggcaagttgcaagggccgtatttgccgttcttaaagccgtagctatgattgcgcttgcattcgtcacggctggtgcgacggctcctggagctgcggcgtccgcggggcaagctgtgagcatagcactcatgtacgagtaccttctaacacccacggagctcacagtatggccactgggtatggataccgtggccaacttgctcattgcgcaggagaatgctgcactggtgggattaattcagctagggccctcgtcgaattttacgagcagacatgtggtgaaaggcatacctgtgagcttgctgctcgatggtgaggattgggagttcgagatccctgtgcaagctggcatgtccagcttccctttcaactggactcgggtcaggattcggcacctggagatgcaatttgcgcaggaggcgagtggtggtgacgagattatccaccagccttccacccggtcggggattgtttacatcctcctgcagggctccactatcttccatgaccgcagaagagatgaggtgatgacctttcaggcagcggacccgctcaacttccaatatgcgtaccgcctcgacactggcgaagccactctaacgaatgagccctcggaagagtttgcgaacacgttcatgcagatgacacccttcactcgctggaggcttcgtctctctgcgtccgcctcagagaatgcagaattagcgtttccaacagctacagctcccgactccactaccgaggttgtcatcacgttccatgttacggcaatcagacaagttgactggcggcaggaggagaaagaggaggag

SEQ ID NO: 25 - protein, 813 aa, Pteridium aquilinum
MGNSIAAAEARNYEEIYKDANHIGAKSLITPVCSEVMTVCRMYVRLDDLDVKVLERAEEVKVLYVVADVVEVRGDAVQLPPSVQLILSCRVLFFSSGNGWPQVALLQGPLVQYNGNYSPVTGNWSATPLLEQDTYRFFLHGQQLLILSGTSGRASGDNILSEDEKKLQLQSSTAPILPPRWVMEDPHILSGLEASVITSELIVGHMTHAVDLVAEVKLHVEWLLLLLRHVLNETMTNAEANHLLRSLFFRVQSLVRMATAAQNNILVVPRLQHHAYSEYINRLAELARTYDSDFKALTLFIQQNEILGSYLLEQNKAFAEKERDMEVVYTTLNDIKMSELIQALGQLERLGEEMGKMSEEMEQAREDMEKGLKIYRNKQVARAAFSLLNAIAQIGLAIFTAGATTGLAASAVANAGQAITQATEAVQQLRRIFETIEKILLLAEVLVAMRDLLAAINDGGELGTLPEWPEMPTTTEWEIFENEVEAVAAGMPEEVSETLVWKAKCKNVAAIGREMVTQAMLVSQLEYDIKVHSLLQEVAQNQAARLEAIQPTDLIDYQEMAAQLDMRTSRILLSLLQVLALQNGALTYSYLMPRTSLSARSVSATMSAVWGLLLHQGQATLVALGELGSPSTRSVEYVVKGIPVGLLLDGEDWDFTIPVADTLHFPSTWSRVRISHVEMKFVKTGGTAAGRDEELVHQPTTDTGKVYIVLRSELFFQDRRKGQYFKYEATVPAIYHYAYNLATSETTEDNRPDEEFARVFMRMTPFTRWKLRVSTSARENQGLAFPTAITPDATTQIVIRFYLSAIRDFDWNR

SEQ ID NO: 26 - protein, 877 aa, Artificial Sequence
  PtIP-83Aa - His tagged
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEEHHHHHHHHHH

SEQ ID NO: 27 - DNA, 2631 bp, Artificial Sequence
  PtIP-83Aa - His tagged
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagagcaccatcaccatcaccatcaccatcaccat

SEQ ID NO: 28 - DNA, 2604 bp, Artificial Sequence
  maize preferred codons
atggctgcactggtcgactacggcaagctgttcgaggacctcaaccagatctcgatgggagtcctggaccgcgtcgagttctccgaggtgatggtgatccaccgcatgtacgtccgccttgccgacctgaacgtcggacagctggagggagccgagaaggtcaagcgcctgtacgtgttcgcggatgtcgtcgagctgccggtcgtcgagtggaggtggccacctcagatcccaggttccgtgaccgtgatcatcctctgccggctcctccagtggccgacagacggcaggcagtctgacaccgagctgcacctgaccttcatgaagctgcacgccatccagcgcgaggagaaccgctgggagatcaccgctgccgacggcatgaactggggtgtgtacatccacgccgaggaggtccaagtgggcgtcctcacgatgtcctggtcgagcgtgctgagggtttccgcgctcaggtcggtcatcaccagcggattccgggcggtcagcgtgttcgaggttcccggatctgtgaggagcacgctgggtgccaccttgaggcctgatcacgcgctgtactcgaccaccatgcaagccacgcccaacgccagccacatctcggccttcaacctgcgcatcgtgagcccgtcagcctatcgcgtgtgtccgctccagaacgacaccgacacctacctgggcatccctgcagatgtcgcagccgttctcccggtcgacgtcgttaccgacccgaacatcctgctgggcatgcagaccaccgtccacatcgccgagctcgtgaaggcttgccacccgtctcctgacgtcgtctcggcggtcggagagcacctgaactggctgaacaagctcctcctgccgctcaaggagtcgacgcagctccaaggctccgagtcctacaaggagtgcctcgccctcctcggacgggttcacgccgcgatgaagatggtgcgcatagggctggtggtccctcagctgcagtaccgcatgtacgggagcctgatcaaccagatggcccaggtggcccagaactacgaccgcgagttcaagcagttcaagctgttcatcatccagaaccagatcctcgggtcgtacctcctgcagcaaaaccgggcgttcgctgagagggagctgcagatggagtccttccacgccgccgtgatctcccagaggcgggaggagctcgacaacacgttcgcgaagatggaccgcctgtccgggcagatggaggcggagtcctcggcgatggagcaggccaagaaggagatggacgagggcctcaggcagttccagaaccggcaggtcgcgaacgcactcttcgccgtgttgtccgcagtggctcagataggcctcgccttcctgaccgcaggcgctacagccccaggagcggttgccagcgctggacaagcggtctcgatcgcaggtcaggctgcacagggactcagacgcgtggtggagatcctggagcagctggaggccgtcatggaggtcgtggcagccgtgaaggacctcgtcgacagcctcgagcaggtcggtcagatcgtcgacgctccagtcatgcccgagttgccgagcgaagccgactggtccatcttcgtcaacgaggtggaggcagtggcagagggtatgcccaccgaggtctctgaggtgcccgtgtggagggcgaagtgcaagaacgtcgctgccttgggccgcgagatgtcgatcacggccgtgcagatgtccgagctccagtacgacatctgggtccaagggatgatgcgcgacatggcgaggagccaggctgatcgcttggccgcgatccagccagcggacctcacgaactacctggagatggcgacccagatggacatgcggacgacccgcatgctgctcgggctcctgaacatcctccgcatccagaacgcggccctgcgctacgagtacctgctgatgcccaccgagctgaccacctggccgttgggtatggacaccgtcggcgacctcctgattgcgcaggagaacgccgcgctcatcggactgatgcagctcggcccatcgtccgacttcaccagcaggcacgtcgtcaaggacatccccgtgaacctgctgctcgacggcgaggactgggagttcgagatcccagttcaggccggcatgagctcgttcccgtccagctggagcagggtccggatacgccacctcgagatgcacttcgtgaaggaggcctcgggcatcggaggcgagatcatccaccagccgaccacgcagacgggcacggtgtacatcctgctgcaaggctcgaccatcttccacgaccgcagacgcgaccaggtcctcccgttccaagccgcagcaccgctgaactaccactacgcgtaccgccttgacaccggtgactccaccttgaccaacgagcccagcgagcagttcgcgaacaagttcatgcagatgaccccgttcacccgctggaggctgaggctctccgcatctgcgaaggagaacgcgggtcttgcgttcccaacggcaacggccctcgactccacgacgcagatcgtcatcaccttccacgtcaccgcgatcaggcagatcgactggcgccacgacgaggag

SEQ ID NO: 29 - DNA, 2604 bp, Artificial Sequence
  maize preferred codons
atggcagcactggtggactacggcaagctcttcgaggacctcaaccagatctctatgggcgtcctggaccgggtcgagttcagcgaggtgatggtgatccaccggatgtacgtgaggctcgccgaccttaacgtgggccagctcgagggtgccgagaaggtgaagcggctgtacgtcttcgccgacgtggtcgagctgccagtggtcgagtggaggtggcctccgcagatcccgggtagcgtgaccgtcatcatcctctgccgcctgcttcagtggcccactgacggacggcagtcagacaccgagctgcacctcaccttcatgaagctgcacgcgatccagcgggaggagaaccggtgggagatcacggcagccgacggcatgaactggggcgtctacatccacgcggaggaggtccaagtgggcgtgctgacgatgtcgtggtcgagcgtgctcagggtttccgcgctgaggagcgtcatcaccagcggctttcgggcagtgtccgtcttcgaggtgccaggctcagtcaggtccacgctcggagccaccctcagacccgatcacgcgctctactccaccaccatgcaagccacgccgaacgcgtcccacatcagcgcgttcaacctccggatagtcagcccatccgcctatcgcgtctgcccgctgcagaacgacaccgacacgtacctcggcattcccgcagacgttgccgcagtcctgcccgtcgatgtggtcaccgacccgaacatcctgctcggcatgcagacgacggtgcacatcgctgagctcgtcaaagcctgccaccctagcccagatgtggtgtcagccgtcggagagcacctgaactggctcaacaagctcctgctgccgctcaaggagtcgacccagctgcaagggtcggagtcctacaaggagtgcctcgcgctgctcggacgggttcacgccgccatgaagatggtccggatcgggttggtcgtgccacagctccagtaccggatgtacggctcgctcatcaaccagatggcccaggtggcccagaactacgaccgggagttcaagcagttcaagctgttcatcatccagaaccagatcctcggctcgtacctgctgcagcagaaccgggcgttcgctgagagggagctgcagatggagtcgttccacgcagccgtgatctcgcagaggcgcgaggagctggacaacaccttcgcgaagatggaccgcctcagcggccagatggaagccgagtcgtccgcgatggagcaggcgaagaaggagatggacgagggcctccggcagttccagaaccggcaggtggcgaacgccctcttcgctgtgcttagcgccgtggctcagatcgggttggcgtttctcaccgccggagccacagctcctggtgcagtggcgtcagcaggtcaagcggtctcgatagccggccaggcagcgcaagggctgaggagggtggtcgagatcctcgagcagctcgaagccgtcatggaggtggtcgccgctgtcaaggacctggtggacagcctcgagcaagtcggccagatcgtggacgcgccagtgatgcccgagttgcccagcgaagcggactggtccatcttcgtgaacgaggtggaggcggtggcagagggcatgcctaccgaggtgagcgaggtgccagtctggagggcgaagtgcaagaacgtcgcggcgctgggtcgggagatgtcgatcaccgcggttcagatgtcggagctccagtacgacatctgggtgcaagggatgatgcgggacatggcgaggtcgcaagccgatcgccttgctgcgatccagcctgccgacctgacgaactacctggagatggccacccagatggacatgcggaccacgcgcatgctcctcggcctgctcaacatcctccgcatccagaacgcggcgctccgctacgagtacctgctgatgcccaccgagctcacgacctggccactcggcatggacaccgttggcgacctcctcatcgcccaggagaacgcggccctcatagggctcatgcagctgggaccgtcgagcgacttcacctcgaggcacgtggtcaaggacatccccgtcaacctgctcctggacggcgaggactgggagttcgagatcccggttcaagccggcatgtcctcgttcccgtcgagctggtcgagagtgcgcatccggcacctggagatgcacttcgtgaaggaggccagcgggataggcggtgagatcatccaccagcccacgacgcagaccggcaccgtgtacatcctcctccaagggtccacgatcttccacgaccggaggcgggatcaggtcttgcccttccaagcggctgcacctctgaactaccactacgcgtatcggctggacaccggcgactcgaccctcaccaacgagccgtccgagcagttcgcgaacaagttcatgcagatgacgcccttcacgcgctggaggctgaggttgtccgcatccgccaaggagaacgctggactcgcctttccgaccgctacggcactcgactccacgacccagatcgtgatcacgttccacgtcaccgccatccgccagatcgactggcggcacgacgaggag

SEQ ID NO: 30 - DNA, 26 bp, Artificial Sequence
  gene primer
ccatggctctcgtggattacggcaag

SEQ ID NO: 31 - DNA, 30 bp, Artificial Sequence
  gene primer
gttaacctactcttcgtcgtgccgccagtc

SEQ ID NO: 32 - DNA, 41 bp, Artificial Sequence
  gene primer
tttaacttagcctaggatccatggaatatagcagcttgtac

SEQ ID NO: 33 - DNA, 42 bp, Artificial Sequence
  gene primer
actccttctttagttaacttactccacatcaccctcttgtcg

SEQ ID NO: 34 - protein, 809 aa, Asplenium australasicum
MAAGDYSVLYQDVNQISIRLEKMDFSEVMAVHRMFVRMDDLDVSSGTGLLSGAEKVKRLYVFADVVELPSKQLRLPGTDLIVILCRIFVTNGRHSTELFLPSMNMSMVAPGTGSIRGVILSPTTVLTTSSDALQFKLQSGSMTSVMRLKDVSVAATLTCNVQAASASMPLTVKTTGTSPGNICVLGMSTAVVVPESAVAVITDANILLGMQVTVLIAELVKIAHNSDVLIAAVTRHVEWLNHLLVQAHAAAPSEDVVALLYRTQGFIKLRNEGLIVPRLQYRMYKDLIDRMVQVAQSYDQDFKQLKLFVEQNKILGSYLLEQNKAFAEKEKDMDAFHSQVIDLRTSELESTIERMDDLSKQMEEQNAAMEQAKADMDAGLIAYQNKQVANAVFAVLGAIASIGLAFATGGATAPGAVASAGAAVTAAGKAAEGLKKVVEILEGLQAVMEVVAVIKELVQSLQEIGQLVDAPEMPDLPSDAEWEIFVNEVEAVAEQMPTEVTEVPAWKAKCKNVAALGREMSTMAAHIAELQFEIQVQEMLREIAKKQADRLSSIKPADLTNYLEMVSEMDMRTTRMLLELIRVLYIQNAALQYEYLQTPAPLNAWPVTMQTVWGLLVQQETAAINGLLQMGAPSDYTQEYAVRDVPVRLLLGGGDWEFELPVRNADFPLTWCRVRIRYVDMRFDAAAEHLPVTSTGEVYMLLQSSRFFEDRAKRENEFISYEGGMGLQYQYAYRLATGDATVTNVPSEEYANTFMRLAPFTRWRLRLSASAPENKGLAFPTATLADATTRIKITFHVSAIRRISTRVAV

SEQ ID NO: 35 - protein, 807 aa, Polypodium musifolium
MADLDYSKLYQDLNQISVRLEKTEFSEVMVVHRMFVRMDDLDVSSGSGLLSGAEKVKRLYVFADVVELPSKQVRLAGTDMIVVFCRIFVPEGRHYAELFLPSMNMSMVGADGEGSIRGVILSPTVLTTLSNALQFRLECGSMTSVMRLNDVSAGATLTCNVQAASACVPLKVKTTGTSPGNICVLGLSTAAVVPESVVAVITDANILLGMQVTVLIAELVKIAHNSDGVIAAVTRHVEWLNHLLVQAQAAAPSEDVVALLYRTQAFIKLRKEGLIVPRLQYHMYKDLIDRMVQVAQSYDQDFKQMKLYVEQNKILGSYLLEQNKAFAEKEKDMDASHSQVIALRTSELQSTIERMDDLSKQMEVQSTAMEKAKADMDAGLIVYQNKQVADAVFAVMEAIASIGLAFATGGATAPGAVASAGAAVSAAGKAGEGLKKVVEILEGLQAIMEVIAAIKGLVQSLQKIGQLVNAPEMPDLPSEAEWEMFVKEVEAVAAQMPTEVTQVPAWTAKCKNVAALGREMSTTAAHIAELQYEIQVQGMLQQIAKKQADRLSSIKPADLTNYFEMVSEMDMRTTRMLLELIQVLNIQNGALRYEYLQPAAPLNAWPVTMQTVWGLLVQQEAAAINGLLQLGAPSDFTREYVVGDIPVKLLLGGGDWEFELPVTDADFPLTWCRVRIQHVDMQFDAAAEHLPTTSTGEVYMLLQSSRFFEDRAQHEDEFISYEAGTGLQYQYAYRLATGEATVTNVPSEAYVNTFMLLAPFTRWRLRLSSSAPENKGLAFPTATSADATTRIKITFHVSAIRRISLAR

SEQ ID NO: 36 - protein, 813 aa, Adiantum pedatum
MADIDYSVLYNDVNQISIRLERMDFSEVMAVHRMFVRMDDLDVSSGTGVLEGAQNVKRLYVFADVVELPSKQVRLPGSDMIVILCRIFVRNGRHNTELFLPSMNMSMVAAGNGTIRGVNLSTTMSSSSSNALQFNLRSGSMTSTVRLKDVDVAAALTCDVQAASASMPLTVMTTGTSPGNIWVLGMTTAVVIPESAVAVITDANILLGMQVTVLIAELVKTAHNSDVIIAAITRHVEWLNHLLVQAHAAAPNEDVITLLYRTQAFIKLKREGLVVPRLQYHMYKNLIDRMVQVAQNYDQDFRQLKLFVEQNKILGSYLLEQNKAFAEKEKDMDAFHSQIIALRTTELNNTIERMGELSKQMDQENEAMEQAKADMDAGLIEYQNRQVANALFAVLGAIASIGLAFATGGATAPGAVSAAGAAVTAAGKAAEGLKKVVEILEGLQVVMEVVAAIKELVQSLQQIGQLVDAPEMPDLPSNADWEIFVNEVEAVAEQMPTEVTQVAAWKAKCKNVAALGREMSTMAAHIAELQYQIQVQEMLREIAQKQADRLSSISPADLTNYLEMVSQMDMRTTRMLLELIRVLYIQNAALQYEYLQTPAPLNAWPVAMQTVWGLLIQQETTAITGLLQLGAPSDFTQEYVVKDIPVSLLLEGRDWEFELPVLNADFPSTWSRVRIHHVDMQFDAAATSIHIPTTNTGVVYLLLQSSRFFDDRARRANEFISYEAGTGLFYQYAYRLATGEATVTNIPTDEYANTFMRLTPFTRWRLRLSLSAEENAGLAFPTATSADDTTQIKITFHVSAIRRISTRSDGVSS

SEQ ID NO: 37 - protein, 5 aa, artificial sequence
  polypeptide linker
EEKKN

SEQ ID NO: 38 - DNA, 44 bp, Artificial Sequence
  mutagenesis primer
  misc_feature (22)..(22): n = a, c, g or t
  misc_feature (23)..(23): n = a, c, g or t
  misc_feature (24)..(24): k = g or t
cagctcgagggagccgagaaannkaagcggttgtatgtgtttgc

SEQ ID NO: 39 - DNA, 43 bp, Artificial Sequence
  mutagenesis primer
  misc_feature (20)..(20): n = a, c, g or t
  misc_feature (21)..(21): n = a, c, g or t
  misc_feature (22)..(22): k = g or t
cgagggagccgagaaagtgnnkcggttgtatgtgtttgcggac

SEQ ID NO: 40 - DNA, 43 bp, Artificial Sequence
  mutagenesis primer
  misc_feature (22)..(22): m = a or c
  misc_feature (23)..(23): n = a, c, g or t
  misc_feature (24)..(24): n = a, c, g or t
gtccgcaaacacatacaaccgmnncactttctcggctccctcg

SEQ ID NO: 41 - DNA, 44 bp, Artificial Sequence
  mutagenesis primer
  misc_feature (21)..(21): n = a, c, g or t
  misc_feature (22)..(22): n = a, c, g or t
  misc_feature (23)..(23): k = g or t
agggagccgagaaagtgaagnnkttgtatgtgtttgcggacgtg

SEQ ID NO: 42 - DNA, 44 bp, Artificial Sequence
  mutagenesis primer
  misc_feature (22)..(22): m = a or c
  misc_feature (23)..(23): n = a, c, g or t
  misc_feature (24)..(24): n = a, c, g or t
cacgtccgcaaacacatacaamnncttcactttctcggctccct

SEQ ID NO: 43 - DNA, 42 bp, Artificial Sequence
  mutagenesis primer
  misc_feature (21)..(21): n = a, c, g or t
  misc_feature (22)..(22): n = a, c, g or t
  misc_feature (23)..(23): k = g or t
gagccgagaaagtgaagcggnnktatgtgtttgcggacgtgg

SEQ ID NO: 44 - DNA, 42 bp, Artificial Sequence
  mutagenesis primer
  misc_feature (20)..(20): m = a or c
  misc_feature (21)..(21): n = a, c, g or t
  misc_feature (22)..(22): n = a, c, g or t
ccacgtccgcaaacacatamnnccgcttcactttctcggctc

SEQ ID NO: 45 - DNA, 44 bp, Artificial Sequence
  mutagenesis primer
  misc_feature (21)..(21): n = a, c, g or t
  misc_feature (22)..(22): n = a, c, g or t
  misc_feature (23)..(23): k = g or t
ccgagaaagtgaagcggttgnnkgtgtttgcggacgtggtggag

SEQ ID NO: 46 - DNA, 44 bp, Artificial Sequence
  mutagenesis primer
  misc_feature (22)..(22): m = a or c
  misc_feature (23)..(23): n = a, c, g or t
  misc_feature (24)..(24): n = a, c, g or t
ctccaccacgtccgcaaacacmnncaaccgcttcactttctcgg

SEQ ID NO: 47 - DNA, 46 bp, Artificial Sequence
  mutagenesis primer
  misc_feature (22)..(22): n = a, c, g or t
  misc_feature (23)..(23): n = a, c, g or t
  misc_feature (24)..(24): k = g or t
gagaaagtgaagcggttgtatnnktttgcggacgtggtggagctac

SEQ ID NO: 48 - DNA, 46 bp, Artificial Sequence
  mutagenesis primer
  misc_feature (23)..(23): m = a or c
  misc_feature (24)..(24): n = a, c, g or t
  misc_feature (25)..(25): n = a, c, g or t
gtagctccaccacgtccgcaaamnnatacaaccgcttcactttctc

SEQ ID NO: 49 - DNA, 43 bp, Artificial Sequence
  mutagenesis primer
  misc_feature (21)..(21): n = a, c, g or t
  misc_feature (22)..(22): n = a, c, g or t
  misc_feature (23)..(23): k = g or t
aagtgaagcggttgtatgtgnnkgcggacgtggtggagctacc

SEQ ID NO: 50 - DNA, 43 bp, Artificial Sequence
  mutagenesis primer
  misc_feature (21)..(21): m = a or c
  misc_feature (22)..(22): n = a, c, g or t
  misc_feature (23)..(23): n = a, c, g or t
ggtagctccaccacgtccgcmnncacatacaaccgcttcactt

SEQ ID NO: 51 - DNA, 46 bp, Artificial Sequence
  mutagenesis primer
  misc_feature (22)..(22): n = a, c, g or t
  misc_feature (23)..(23): n = a, c, g or t
  misc_feature (24)..(24): k = g or t
gtgaagcggttgtatgtgtttnnkgacgtggtggagctaccagtcg

SEQ ID NO: 52 - DNA, 46 bp, Artificial Sequence
  mutagenesis primer
  misc_feature (23)..(23): m = a or c
  misc_feature (24)..(25): n = a, c, g or t
cgactggtagctccaccacgtcmnnaaacacatacaaccgcttcac

SEQ ID NO: 53 - DNA, 47 bp, Artificial Sequence
  mutagenesis primer
  misc_feature (23)..(24): n = a, c, g or t
  misc_feature (25)..(25): k = g or t
gaagcggttgtatgtgtttgcgnnkgtggtggagctaccagtcgtgg

SEQ ID NO: 54 - DNA, 47 bp, Artificial Sequence
  mutagenesis primer
  misc_feature (23)..(23): m = a or c
  misc_feature (24)..(25): n = a, c, g or t
ccacgactggtagctccaccacmnncgcaaacacatacaaccgcttc

SEQ ID NO: 55 - DNA, 42 bp, Artificial Sequence
  mutagenesis primer
  misc_feature (21)..(22): n = a, c, g or t
  misc_feature (23)..(23): k = g or t
ggttgtatgtgtttgcggacnnkgtggagctaccagtcgtgg

SEQ ID NO: 56 - DNA, 42 bp, Artificial Sequence
  mutagenesis primer
  misc_feature (20)..(20): m = a or c
  misc_feature (21)..(22): n = a, c, g or t
ccacgactggtagctccacmnngtccgcaaacacatacaacc

SEQ ID NO: 57 - DNA, 44 bp, Artificial Sequence
  mutagenesis primer
  misc_feature (21)..(22): n = a, c, g or t
  misc_feature (23)..(23): k = g or t
tgtatgtgtttgcggacgtgnnkgagctaccagtcgtggaatgg

SEQ ID NO: 58 - DNA, 44 bp, Artificial Sequence
  mutagenesis primer
  misc_feature (22)..(22): m = a or c
  misc_feature (23)..(24): n = a, c, g or t
ccattccacgactggtagctcmnncacgtccgcaaacacataca

SEQ ID NO: 59 - DNA, 43 bp, Artificial Sequence
  mutagenesis primer
  misc_feature (21)..(22): n = a, c, g or t
  misc_feature (23)..(23): k = g or t
atgtgtttgcggacgtggtgnnkctaccagtcgtggaatggcg

SEQ ID NO: 60 - DNA, 43 bp, Artificial Sequence
  mutagenesis primer
  misc_feature (21)..(21): m = a or c
  misc_feature (22)..(23): n = a, c, g or t
cgccattccacgactggtagmnncaccacgtccgcaaacacat

SEQ ID NO: 61 - DNA, 43 bp, Artificial Sequence
  mutagenesis primer
  misc_feature (21)..(22): n = a, c, g or t
  misc_feature (23)..(23): k = g or t
tgtttgcggacgtggtggagnnkccagtcgtggaatggcggtg

SEQ ID NO: 62 - DNA, 43 bp, Artificial Sequence
  mutagenesis primer
  misc_feature (21)..(21): m = a or c
  misc_feature (22)..(23): n = a, c, g or t
caccgccattccacgactggmnnctccaccacgtccgcaaaca

SEQ ID NO: 63 - DNA, 45 bp, Artificial Sequence
  mutagenesis primer
  misc_feature (23)..(24): n = a, c, g or t
  misc_feature (25)..(25): k = g or t
gtttgcggacgtggtggagctannkgtcgtggaatggcggtggcc

SEQ ID NO: 64 - DNA, 45 bp, Artificial Sequence
  mutagenesis primer
  misc_feature (21)..(21): m = a or c
  misc_feature (22)..(23): n = a, c, g or t
ggccaccgccattccacgacmnntagctccaccacgtccgcaaac

SEQ ID NO: 65 - DNA, 55 bp, Artificial Sequence
  mutagenesis primer
  misc_feature (22)..(23): n = a, c, g or t
  misc_feature (24)..(24): k = g or t
  misc_feature (32)..(33): n is a, c, g, or t
caagcaattcaaattattcatcatccaaaatnnkatccttggcagctatttgctg

SEQ ID NO: 66 - DNA, 53 bp, Artificial Sequence
  mutagenesis primer
  misc_feature (20)..(20): m = a or c
  misc_feature (21)..(22): n = a, c, g or t
gcaaatagctgccaaggatmnnattttggatgatgaataatttgaattgcttg

SEQ ID NO: 67 - DNA, 53 bp, Artificial Sequence
  mutagenesis primer
  misc_feature (32)..(33): n = a, c, g or t
  misc_feature (34)..(34): k = g or t
gcaattcaaattattcatcatccaaaatcaannkcttggcagctatttgctgc

SEQ ID NO: 68 - DNA, 53 bp, Artificial Sequence
  mutagenesis primer
  misc_feature (20)..(20): m = a or c
  misc_feature (21)..(22): n = a, c, g or t
gcagcaaatagctgccaagmnnttgattttggatgatgaataatttgaattgc

SEQ ID NO: 69 - DNA, 56 bp, Artificial Sequence
  mutagenesis primer
  misc_feature (35)..(36): n = a, c, g or t
  misc_feature (37)..(37): k = g or t
gcaattcaaattattcatcatccaaaatcaaatcnnkggcagctatttgctgcagc

SEQ ID NO: 70 - DNA, 56 bp, Artificial Sequence
  mutagenesis primer
  misc_feature (20)..(20): m = a or c
  misc_feature (21)..(22): n = a, c, g or t
gctgcagcaaatagctgccmnngatttgattttggatgatgaataatttgaattgc

SEQ ID NO: 71 - DNA, 52 bp, Artificial Sequence
  mutagenesis primer
  misc_feature (32)..(33): n = a, c, g or t
  misc_feature (34)..(34): K = g or t
caaattattcatcatccaaaatcaaatccttnnkagctatttgctgcagcag

SEQ ID NO: 72 - DNA, 52 bp, Artificial Sequence
  mutagenesis primer
  misc_feature (19)..(19): m = a or c
  misc_feature (20)..(21): n = a, c, g or t
ctgctgcagcaaatagctmnnaaggatttgattttggatgatgaataatttg

SEQ ID NO: 73 - DNA, 48 bp, Artificial Sequence
  mutagenesis primer
  misc_feature (26)..(27): n = a, c, g or t
  misc_feature (28)..(28): k = g or t
catcatccaaaatcaaatccttggcnnktatttgctgcagcagaacag

SEQ ID NO: 74 - DNA, 48 bp, Artificial Sequence
  mutagenesis primer
  misc_feature (21)..(21): m = a or c
  misc_feature (22)..(23): n = a, c, g or t
ctgttctgctgcagcaaatamnngccaaggatttgattttggatgatg

SEQ ID NO: 75 - DNA, 43 bp, Artificial Sequence
  mutagenesis primer
  misc_feature (23)..(24): n = a, c, g or t
  misc_feature (25)..(25): k = g or t
ccaaaatcaaatccttggcagcnnkttgctgcagcagaacagg

SEQ ID NO: 76 - DNA, 43 bp, Artificial Sequence
  mutagenesis primer
  misc_feature (19)..(19): m = a or c
  misc_feature (20)..(21): n = a, c, g or t
cctgttctgctgcagcaamnngctgccaaggatttgattttgg

SEQ ID NO: 77 - DNA, 50 bp, Artificial Sequence
  mutagenesis primer
  misc_feature (26)..(27): n = a, c, g or t
  misc_feature (28)..(28): k = g or t
ccaaaatcaaatccttggcagctatnnkctgcagcagaacagggcatttg

SEQ ID NO: 78 - DNA, 50 bp, Artificial Sequence
  mutagenesis primer
  misc_feature (23)..(23): m = a or c
  misc_feature (24)..(25): n = a, c, g or t
caaatgccctgttctgctgcagmnnatagctgccaaggatttgattttgg

SEQ ID NO: 79 - DNA, 43 bp, Artificial Sequence
  mutagenesis primer
  misc_feature (22)..(23): n = a, c, g or t
  misc_feature (24)..(24): k = g or t
caaatccttggcagctatttgnnkcagcagaacagggcatttg

SEQ ID NO: 80 - DNA, 43 bp, Artificial Sequence
  mutagenesis primer
  misc_feature (20)..(20): m = a or c
  misc_feature (21)..(22): n = a, c, g or t
caaatgccctgttctgctgmnncaaatagctgccaaggatttg

SEQ ID NO: 81 - DNA, 41 bp, Artificial Sequence
  mutagenesis primer
  misc_feature (20)..(21): n = a, c, g or t
  misc_feature (22)..(22): k = g or t
ccttggcagctatttgctgnnkcagaacagggcatttgctg

SEQ ID NO: 82 - DNA, 41 bp, Artificial Sequence
  mutagenesis primer
  misc_feature (20)..(20): m = a or c
  misc_feature (21)..(22): n = a, c, g or t
cagcaaatgccctgttctgmnncagcaaatagctgccaagg

SEQ ID NO: 83 - DNA, 41 bp, Artificial Sequence
  mutagenesis primer
  misc_feature (19)..(20): n = a, c, g or t
  misc_feature (21)..(21): k = g or t
ggcagctatttgctgcagnnkaacagggcatttgctgagag

SEQ ID NO: 84 - DNA, 41 bp, Artificial Sequence
  mutagenesis primer
  misc_feature (21)..(21): m = a or c
  misc_feature (22)..(23): n = a, c, g or t
ctctcagcaaatgccctgttmnnctgcagcaaatagctgcc

SEQ ID NO: 85 - DNA, 40 bp, Artificial Sequence
  mutagenesis primer
  misc_feature (20)..(21): n = a, c, g or t
  misc_feature (22)..(22): k = g or t
cagctatttgctgcagcagnnkagggcatttgctgagagg

SEQ ID NO: 86 - DNA, 40 bp, Artificial Sequence
  mutagenesis primer
  misc_feature (19)..(19): m = a or c
  misc_feature (20)..(21): n = a, c, g or t
cctctcagcaaatgccctmnnctgctgcagcaaatagctg

SEQ ID NO: 87 - DNA, 46 bp, Artificial Sequence
  mutagenesis primer
  misc_feature (22)..(23): n = a, c, g or t
  misc_feature (224)..(24): k = g or t
gaagtctcggaggttccggtgnnkagggccaagtgcaagaatgtgg

SEQ ID NO: 88 - DNA, 46 bp, Artificial Sequence
  mutagenesis primer
  misc_feature (23)..(23): m = a or c
  misc_feature (24)..(25): n = a, c, g or t
ccacattcttgcacttggccctmnncaccggaacctccgagacttc

SEQ ID NO: 89 - DNA, 44 bp, Artificial Sequence
  mutagenesis primer
  misc_feature (22)..(23): n = a, c, g or t
  misc_feature (24)..(24): k = g or t
gtctcggaggttccggtgtggnnkgccaagtgcaagaatgtggc

SEQ ID NO: 90 - DNA, 44 bp, Artificial Sequence
  mutagenesis primer
  misc_feature (21)..(21): m = a or c
  misc_feature (22)..(23): n = a, c, g or t
gccacattcttgcacttggcmnnccacaccggaacctccgagac

SEQ ID NO: 91 - DNA, 45 bp, Artificial Sequence
  mutagenesis primer
  misc_feature (21)..(22): n = a, c, g or t
  misc_feature (23)..(23): k = g or t
cggaggttccggtgtggaggnnkaagtgcaagaatgtggctgcac

SEQ ID NO: 92 - DNA, 45 bp, Artificial Sequence
  mutagenesis primer
  misc_feature (23)..(23): m = a or c
  misc_feature (24)..(25): n = a, c, g or t
gtgcagccacattcttgcacttmnncctccacaccggaacctccg

SEQ ID NO: 93 - DNA, 45 bp, Artificial Sequence
  mutagenesis primer
  misc_feature (22)..(23): n = a, c, g or t
  misc_feature (24)..(24): k = g or t
gaggttccggtgtggagggccnnktgcaagaatgtggctgcactg

SEQ ID NO: 94 - DNA, 45 bp, Artificial Sequence
  mutagenesis primer
  misc_feature (22)..(22): m = a or c
  misc_feature (23)..(24): n = a, c, g or t
cagtgcagccacattcttgcamnnggccctccacaccggaacctc

SEQ ID NO: 95 - DNA, 46 bp, Artificial Sequence
  mutagenesis primer
  misc_feature (22)..(23): n = a, c, g or t
  misc_feature (24)..(24): k = g or t
gttccggtgtggagggccaagnnkaagaatgtggctgcactgggtc

SEQ ID NO: 96 - DNA, 46 bp, Artificial Sequence
  mutagenesis primer
  misc_feature (23)..(23): m = a or c
  misc_feature (24)..(25): n = a, c, g or t
gacccagtgcagccacattcttmnncttggccctccacaccggaac

SEQ ID NO: 97 - DNA, 43 bp, Artificial Sequence
  mutagenesis primer
  misc_feature (21)..(22): n = a, c, g or t
  misc_feature (23)..(23): k = g or t
cggtgtggagggccaagtgcnnkaatgtggctgcactgggtcg

SEQ ID NO: 98 - DNA, 43 bp, Artificial Sequence
  mutagenesis primer
  misc_feature (21)..(21): m = a or c
  misc_feature (22)..(23): n = a, c, g or t
cgacccagtgcagccacattmnngcacttggccctccacaccg

SEQ ID NO: 99 - DNA, 45 bp, Artificial Sequence
  mutagenesis primer
  misc_feature (22)..(23): n = a, c, g or t
  misc_feature (24)..(24): k = g or t
gtgtggagggccaagtgcaagnnkgtggctgcactgggtcgggag

SEQ ID NO: 100 - DNA, 45 bp, Artificial Sequence
  mutagenesis primer
  misc_feature (22)..(22): m = a or c
  misc_feature (23)..(24): n = a, c, g or t
ctcccgacccagtgcagccacmnncttgcacttggccctccacac

SEQ ID NO: 101 - DNA, 44 bp, Artificial Sequence
  mutagenesis primer
  misc_feature (21)..(22): n = a, c, g or t
  misc_feature (23)..(23): k = g or t
ggagggccaagtgcaagaatnnkgctgcactgggtcgggagatg

SEQ ID NO: 102 - DNA, 44 bp, Artificial Sequence
  mutagenesis primer
  misc_feature (22)..(22): m = a or c
  misc_feature (23)..(24): n = a, c, g or t
catctcccgacccagtgcagcmnnattcttgcacttggccctcc

SEQ ID NO: 103 - DNA, 46 bp, Artificial Sequence
  mutagenesis primer
  misc_feature (23)..(24): n = a, c, g or t
  misc_feature (25)..(25): k = g or t
gagggccaagtgcaagaatgtgnnkgcactgggtcgggagatgagc

SEQ ID NO: 104 - DNA, 46 bp, Artificial Sequence
  mutagenesis primer
  misc_feature (22)..(22): m = a or c
  misc_feature (23)..(24): n = a, c, g or t
gctcatctcccgacccagtgcmnncacattcttgcacttggccctc

SEQ ID NO: 105 - DNA, 43 bp, Artificial Sequence
  mutagenesis primer
  misc_feature (21)..(22): n = a, c, g or t
  misc_feature (23)..(23): k = g or t
cggcgctcaggtacgagtatnnkctaatgcccacggagctcac

SEQ ID NO: 106 - DNA, 43 bp, Artificial Sequence
  mutagenesis primer
  misc_feature (21)..(21): m = a or c
  misc_feature (22)..(23): n = a, c, g or t
gtgagctccgtgggcattagmnnatactcgtacctgagcgccg

SEQ ID NO: 107 - DNA, 43 bp, Artificial Sequence
  mutagenesis primer
  misc_feature (21)..(22): n = a, c, g or t
  misc_feature (23)..(23): k = g or t
cgctcaggtacgagtatcttnnkatgcccacggagctcacaac

SEQ ID NO: 108 - DNA, 43 bp, Artificial Sequence
  mutagenesis primer
  misc_feature (21)..(21): m = a or c
  misc_feature (22)..(23): n = a, c, g or t
gttgtgagctccgtgggcatmnnaagatactcgtacctgagcg

SEQ ID NO: 109 - DNA, 46 bp, Artificial Sequence
  mutagenesis primer
  misc_feature (23)..(24): n = a, c, g or t
  misc_feature (25)..(25): k = g or t
gctcaggtacgagtatcttctannkcccacggagctcacaacatgg

SEQ ID NO: 110 - DNA, 46 bp, Artificial Sequence
  mutagenesis primer
  misc_feature (22)..(22): m = a or c
  misc_feature (23)..(24): n = a, c, g or t
ccatgttgtgagctccgtgggmnntagaagatactcgtacctgagc

SEQ ID NO: 111 - DNA, 43 bp, Artificial Sequence
  mutagenesis primer
  misc_feature (21)..(22): n = a, c, g or t
  misc_feature (23)..(23): k = g or t
ggtacgagtatcttctaatgnnkacggagctcacaacatggcc

SEQ ID NO: 112 - DNA, 43 bp, Artificial Sequence
  mutagenesis primer
  misc_feature (21)..(21): m = a or c
  misc_feature (22)..(23): n = a, c, g or t
ggccatgttgtgagctccgtmnncattagaagatactcgtacc

SEQ ID NO: 113 - DNA, 47 bp, Artificial Sequence
  mutagenesis primer
  misc_feature (24)..(25): n = a, c, g or t
  misc_feature (26)..(26): k = g or t
ggtacgagtatcttctaatgcccnnkgagctcacaacatggccactg

SEQ ID NO: 114 - DNA, 47 bp, Artificial Sequence
  mutagenesis primer
  misc_feature (22)..(22): m = a or c
  misc_feature (22)..(24): n = a, c, g or t
cagtggccatgttgtgagctcmnngggcattagaagatactcgtacc

SEQ ID NO: 115 - DNA, 45 bp, Artificial Sequence
  mutagenesis primer
  misc_feature (23)..(24): n = a, c, g or t
  misc_feature (25)..(25): k = g or t
cgagtatcttctaatgcccacgnnkctcacaacatggccactggg

SEQ ID NO: 116 - DNA, 45 bp, Artificial Sequence
  mutagenesis primer
  misc_feature (21)..(21): m = a or c
  misc_feature (22)..(23): n = a, c, g or t
cccagtggccatgttgtgagmnncgtgggcattagaagatactcg

SEQ ID NO: 117 - DNA, 49 bp, Artificial Sequence
  mutagenesis primer
  misc_feature (25)..(26): n = a, c, g or t
  misc_feature (27)..(27): k = g or t
gagtatcttctaatgcccacggagnnkacaacatggccactgggtatgg

SEQ ID NO: 118 - DNA, 49 bp, Artificial Sequence
  mutagenesis primer
  misc_feature (23)..(23): m = a or c
  misc_feature (24)..(25): n = a, c, g or t
ccatacccagtggccatgttgtmnnctccgtgggcattagaagatactc

SEQ ID NO: 119 - DNA, 47 bp, Artificial Sequence
  mutagenesis primer
  misc_feature (22)..(23): n = a, c, g or t
  misc_feature (24)..(24): k = g or t
cttctaatgcccacggagctcnnkacatggccactgggtatggatac

SEQ ID NO: 120 - DNA, 47 bp, Artificial Sequence
  mutagenesis primer
  misc_feature (24)..(24): m = a or c
  misc_feature (25)..(26): n = a, c, g or t
gtatccatacccagtggccatgtmnngagctccgtgggcattagaag

SEQ ID NO: 121 - DNA, 45 bp, Artificial Sequence
  mutagenesis primer
  misc_feature (22)..(23): n = a, c, g or t
  misc_feature (24)..(24): k = g or t
ctaatgcccacggagctcacannktggccactgggtatggatacc

SEQ ID NO: 122 - DNA, 45 bp, Artificial Sequence
  mutagenesis primer
  misc_feature (22)..(22): m = a or c
  misc_feature (23)..(24): n = a, c, g or t
ggtatccatacccagtggccamnntgtgagctccgtgggcattag

SEQ ID NO: 123 - DNA, 44 bp, Artificial Sequence
  mutagenesis primer
  misc_feature (20)..(21): n = a, c, g or t
  misc_feature (22)..(22): k = g or t
gcccacggagctcacaacannkccactgggtatggataccgtgg

SEQ ID NO: 124 - DNA, 44 bp, Artificial Sequence
  mutagenesis primer
  misc_feature (23)..(23): m = a or c
  misc_feature (24)..(25): n = a, c, g or t
ccacggtatccatacccagtggmnntgttgtgagctccgtgggc

SEQ ID NO: 125 - DNA, 47 bp, Artificial Sequence
  mutagenesis primer
  misc_feature (21)..(22): n = a, c, g or t
  misc_feature (23)..(23): k = g or t
ccactatcttccatgaccgcnnkagagaccaggtgttgccttttcag

SEQ ID NO: 126 - DNA, 47 bp, Artificial Sequence
  mutagenesis primer
  misc_feature (25)..(25): m = a or c
  misc_feature (26)..(27): n = a, c, g or t
ctgaaaaggcaacacctggtctctmnngcggtcatggaagatagtgg

SEQ ID NO: 127 - DNA, 45 bp, Artificial Sequence
  mutagenesis primer
  misc_feature (21)..(22): n = a, c, g or t
  misc_feature (23)..(23): k = g or t
ctatcttccatgaccgcagannkgaccaggtgttgccttttcagg

SEQ ID NO: 128 - DNA, 45 bp, Artificial Sequence
  mutagenesis primer
  misc_feature (23)..(23): m = a or c
  misc_feature (24)..(25): n = a, c, g or t
cctgaaaaggcaacacctggtcmnntctgcggtcatggaagatag

SEQ ID NO: 129 - DNA, 46 bp, Artificial Sequence
  mutagenesis primer
  misc_feature (24)..(25): n = a, c, g or t
  misc_feature (26)..(26): k = g or t
ctatcttccatgaccgcagaagannkcaggtgttgccttttcaggc

SEQ ID NO: 130 - DNA, 46 bp, Artificial Sequence
  mutagenesis primer
  misc_feature (21)..(21): m = a or c
  misc_feature (22)..(23): n = a, c, g or t
gcctgaaaaggcaacacctgmnntcttctgcggtcatggaagatag

SEQ ID NO: 131 - DNA, 45 bp, Artificial Sequence
  mutagenesis primer
  misc_feature (23)..(24): n = a, c, g or t
  misc_feature (25)..(25): k = g or t
cttccatgaccgcagaagagacnnkgtgttgccttttcaggccgc

SEQ ID NO: 132 - DNA, 45 bp, Artificial Sequence
  mutagenesis primer
  misc_feature (21)..(21): m = a or c
  misc_feature (22)..(23): n = a, c, g or t
gcggcctgaaaaggcaacacmnngtctcttctgcggtcatggaag

SEQ ID NO: 133 - DNA, 44 bp, Artificial Sequence
  mutagenesis primer
  misc_feature (22)..(23): n = a, c, g or t
  misc_feature (24)..(24): k = g or t
catgaccgcagaagagaccagnnkttgccttttcaggccgctgc

SEQ ID NO: 134 - DNA, 44 bp, Artificial Sequence
  mutagenesis primer
  misc_feature (21)..(21): m = a or c
  misc_feature (22)..(23): n = a, c, g or t
gcagcggcctgaaaaggcaamnnctggtctcttctgcggtcatg

SEQ ID NO: 135 - DNA, 44 bp, Artificial Sequence
  mutagenesis primer
  misc_feature (22)..(23): n = a, c, g or t
  misc_feature (24)..(24): k = g or t
gaccgcagaagagaccaggtgnnkccttttcaggccgctgctcc

SEQ ID NO: 136 - DNA, 44 bp, Artificial Sequence
  mutagenesis primer
  misc_feature (21)..(21): m = a or c
  misc_feature (22)..(23): n = a, c, g or t
ggagcagcggcctgaaaaggmnncacctggtctcttctgcggtc

SEQ ID NO: 137 - DNA, 44 bp, Artificial Sequence
  mutagenesis primer
  misc_feature (21)..(22): n = a, c, g or t
  misc_feature (23)..(23): k = g or t
gcagaagagaccaggtgttgnnktttcaggccgctgctccgctc

SEQ ID NO: 138 - DNA, 44 bp, Artificial Sequence
  mutagenesis primer
  misc_feature (22)..(22): m = a or c
  misc_feature (23)..(24): n = a, c, g or t
gagcggagcagcggcctgaaamnncaacacctggtctcttctgc

SEQ ID NO: 139 - DNA, 44 bp, Artificial Sequence
  mutagenesis primer
  misc_feature (21)..(22): n = a, c, g or t
  misc_feature (23)..(23): k = g or t
gaagagaccaggtgttgcctnnkcaggccgctgctccgctcaac

SEQ ID NO: 140 - DNA, 44 bp, Artificial Sequence
  mutagenesis primer
  misc_feature (22)..(22): m = a or c
  misc_feature (23)..(24): n = a, c, g or t
gttgagcggagcagcggcctgmnnaggcaacacctggtctcttc

SEQ ID NO: 141 - DNA, 44 bp, Artificial Sequence
  mutagenesis primer
  misc_feature (21)..(22): n = a, c, g or t
  misc_feature (23)..(23): k = g or t
gagaccaggtgttgccttttnnkgccgctgctccgctcaactac

SEQ ID NO: 142 - DNA, 44 bp, Artificial Sequence
  mutagenesis primer
  misc_feature (22)..(22): m = a or c
  misc_feature (23)..(24): n = a, c, g or t
gtagttgagcggagcagcggcmnnaaaaggcaacacctggtctc

SEQ ID NO: 143 - DNA, 43 bp, Artificial Sequence
  mutagenesis primer
  misc_feature (22)..(23): n = a, c, g or t
  misc_feature (24)..(24): k = g or t
gaccaggtgttgccttttcagnnkgctgctccgctcaactacc

SEQ ID NO: 144 - DNA, 43 bp, Artificial Sequence
  mutagenesis primer
  misc_feature (20)..(20): m = a or c
  misc_feature (21)..(22): n = a, c, g or t
ggtagttgagcggagcagcmnnctgaaaaggcaacacctggtc

SEQ ID NO: 145 - DNA, 47 bp, Artificial Sequence
  mutagenesis primer
  misc_feature (23)..(24): n = a, c, g or t
  misc_feature (25)..(25): k = g or t
ccaggtgttgccttttcaggccnnkgctccgctcaactaccattacg

SEQ ID NO: 146 - DNA, 47 bp, Artificial Sequence
  mutagenesis primer
  misc_feature (23)..(23): m = a or c
  misc_feature (24)..(25): n = a, c, g or t
cgtaatggtagttgagcggagcmnnggcctgaaaaggcaacacctgg

SEQ ID NO: 147 - DNA, 45 bp, Artificial Sequence
  mutagenesis primer
  misc_feature (22)..(23): n = a, c, g or t
  misc_feature (24)..(24): k = g or t
gtgttgccttttcaggccgctnnkccgctcaactaccattacgcg

SEQ ID NO: 148 - DNA, 45 bp, Artificial Sequence
  mutagenesis primer
  misc_feature (22)..(22): m = a or c
  misc_feature (23)..(24): n = a, c, g or t
cgcgtaatggtagttgagcggmnnagcggcctgaaaaggcaacac

SEQ ID NO: 149 - DNA, 46 bp, Artificial Sequence
  mutagenesis primer
  misc_feature (23)..(24): n = a, c, g or t
  misc_feature (25)..(25): k = g or t
gttgccttttcaggccgctgctnnkctcaactaccattacgcgtac

SEQ ID NO: 150 - DNA, 46 bp, Artificial Sequence
  mutagenesis primer
  misc_feature (22)..(22): m = a or c
  misc_feature (23)..(24): n = a, c, g or t
gtacgcgtaatggtagttgagmnnagcagcggcctgaaaaggcaac

SEQ ID NO: 151 - DNA, 44 bp, Artificial Sequence
  mutagenesis primer
  misc_feature (22)..(23): n = a, c, g or t
  misc_feature (24)..(24): k = g or t
ccttttcaggccgctgctccgnnkaactaccattacgcgtaccg

SEQ ID NO: 152 - DNA, 44 bp, Artificial Sequence
  mutagenesis primer
  misc_feature (21)..(21): m = a or c
  misc_feature (22)..(23): n = a, c, g or t
cggtacgcgtaatggtagttmnncggagcagcggcctgaaaagg

SEQ ID NO: 153 - DNA, 42 bp, Artificial Sequence
  mutagenesis primer
  misc_feature (19)..(20): n = a, c, g or t
  misc_feature (21)..(21): k = g or t
caggccgctgctccgctcnnktaccattacgcgtaccgcctc

SEQ ID NO: 154 - DNA, 42 bp, Artificial Sequence
  mutagenesis primer
  misc_feature (22)..(22): m = a or c
  misc_feature (23)..(24): n = a, c, g or t
gaggcggtacgcgtaatggtamnngagcggagcagcggcctg

SEQ ID NO: 155 - DNA, 45 bp, Artificial Sequence
  mutagenesis primer
  misc_feature (22)..(23): n = a, c, g or t
  misc_feature (24)..(24): k = g or t
caggccgctgctccgctcaacnnkcattacgcgtaccgcctcgac

SEQ ID NO: 156 - DNA, 45 bp, Artificial Sequence
  mutagenesis primer
  misc_feature (22)..(22): m = a or c
  misc_feature (23)..(24): n = a, c, g or t
gtcgaggcggtacgcgtaatgmnngttgagcggagcagcggcctg

SEQ ID NO: 157 - DNA, 78 bp, Artificial Sequence
  mutagenesis primer
  misc_feature (23)..(23): d = a, g or t
  misc_feature (26)..(26): r = a or g
  misc_feature (27)..(27): s = c or g
  misc_feature (28)..(28): y = c or t
  misc_feature (34)..(34): r = a or g
  misc_feature (40)..(40): d = a, g or t
  misc_feature (41)..(41): s = c or g
  misc_feature (46)..(46): r = a or g
  misc_feature (49)..(49): v = a, c or g
  misc_feature (53)..(53): w = a or t
  misc_feature (55)..(55): v = a, c or g
ctcgagggagccgagaaagtgadgcrsytctatrtcttkdscgacrtcvtcgwgvtcccagtcgtggaatggcggtgg

SEQ ID NO: 158 - DNA, 78 bp, Artificial Sequence
  mutagenesis primer
  misc_feature (23)..(23): d = a, g or t
  misc_feature (26)..(26): r = a or g
  misc_feature (27)..(27): s = c or g
  misc_feature (28)..(28): y = c or t
  misc_feature (31)..(31): v = a, c or g
  misc_feature (34)..(34): r = a or g
  misc_feature (39)..(39): k = g or t
  misc_feature (40)..(40): d = a, g or t
  misc_feature (41)..(41): s = c or g
  misc_feature (46)..(46): r = a or g
  misc_feature (49)..(49): v = a, c or g
  misc_feature (53)..(53): w = a or t
  misc_feature (55)..(55): v = a, c or g
ctcgagggagccgagaaagtgadgcrsytcvtcrtcttkdscgacrtcvtcgwgvtcccagtcgtggaatggcggtgg

SEQ ID NO: 159 - DNA, 78 bp, Artificial Sequence
  mutagenesis primer
  misc_feature (24)..(24): b = c, g or t
  misc_feature (26)..(26): w = a or t
  misc_feature (30)..(30): b = c, g or t
  misc_feature (33)..(33): y = c or t
  misc_feature (38)..(38): s = c or g
  misc_feature (39)..(39): h = a, c or t
  misc_feature (40)..(40): m = a or c
  misc_feature (45)..(45): y = c or t
  misc_feature (51)..(51): r = a or g
  misc_feature (52)..(52): s = c or g
  misc_feature (53)..(53): y = c or t
  misc_feature (56)..(56): h = a, c or t
ccaccgccattccacgactgggabcwcgabgaygtcgshmaagayatagarsygchtcactttctcggctccctcgag

SEQ ID NO: 160 - DNA, 78 bp, Artificial Sequence
  mutagenesis primer
  misc_feature (24)..(24): b = c, g or t
  misc_feature (26)..(26): w = a or t
  misc_feature (30)..(30): b = c, g or t
  misc_feature (33)..(33): y = c or t
  misc_feature (38)..(38): s = c or g
  misc_feature (39)..(39): h = a, c or t
  misc_feature (40)..(40): m = a or c
  misc_feature (45)..(45): y = c or t
  misc_feature (48)..(48): b = c, g or t
  misc_feature (51)..(51): r = a or g
  misc_feature (52)..(52): s = c or g
  misc_feature (53)..(53): y = c or t
  misc_feature (56)..(56): h = a, c or t
ccaccgccattccacgactgggabcwcgabgaygtcgshmaagaygabgarsygchtcactttctcggctccctcgag

SEQ ID NO: 161 - DNA, 84 bp, Artificial Sequence
  mutagenesis primer
  misc_feature (29)..(29): w = a or t
  misc_feature (33)..(33): b = c, g or t
  misc_feature (36)..(36): y = c or t
  misc_feature (42)..(42): h = a, c or t
  misc_feature (48)..(48): y = c or t
  misc_feature (55)..(55): s = c or g
  misc_feature (56)..(56): y = c or t
  misc_feature (59)..(59): h = a, c or t
cggccaccgccattccacgactggtagcwcgabaaygtcgshaaaaayatacaasygchtcactttctcggctccctcgagctg

SEQ ID NO: 162 - DNA, 51 bp, Artificial Sequence
  cDNA cloning primer
aatctctcatctaagaggctggatcctaggatggctctcgtggattacggc

SEQ ID NO: 163 - DNA, 52 bp, Artificial Sequence
  cDNA cloning primer
tggccaatccagaagatggacaagtctagactactcttcgtcgtgccgccag

SEQ ID NO: 164 - DNA, 27 bp, Artificial Sequence
  mutagenesis primer
ctaccagtcgtggaatggcggtggccg

SEQ ID NO: 165 - DNA, 63 bp, Artificial Sequence
  mutagenesis primer
  misc_feature (23)..(23): b = c, g or t
  misc_feature (24)..(24): s = c or g
  misc_feature (26)..(26): b = c, g or t
  misc_feature (28)..(28): m = a or c
  misc_feature (29)..(29): r = a or g
  misc_feature (36)..(36): s = c or g
  misc_feature (37)..(37): w = a ot t
  misc_feature (38)..(38): s = c or g
gtctcggaggttccggtgtggabsgbcmrgtgcaaswscgtggctgcactgggtcgggagatg

SEQ ID NO: 166 - DNA, 63 bp, Artificial Sequence
  mutagenesis primer
  misc_feature (23)..(23): w = a or t
  misc_feature (24)..(24): s = c or g
  misc_feature (26)..(26): b = c, g or t
  misc_feature (28)..(28): m = a or c
  misc_feature (29)..(29): r = a or g
  misc_feature (36)..(36): s = c or g
  misc_feature (37)..(37): w = a or t
  misc_feature (38)..(38): s = a or t
gtctcggaggttccggtgtggcwsgbcmrgtgcaaswscgtggctgcactgggtcgggagatg

SEQ ID NO: 167 - DNA, 63 bp, Artificial Sequence
  mutagenesis primer
  misc_feature (23)..(23): b = c, g or t
  misc_feature (24)..(24): s = c or g
  misc_feature (26)..(26): b = c, g or t
  misc_feature (28)..(28): m = a or c
  misc_feature (29)..(29): r = a or g
  misc_feature (36)..(36): s = c or g
  misc_feature (37)..(37): m = a or c
gtctcggaggttccggtgtggabsgbcmrgtgcaasmatgtggctgcactgggtcgggagatg

SEQ ID NO: 168 - DNA, 63 bp, Artificial Sequence
  mutagenesis primer
  misc_feature (23)..(23): w a or t
  misc_feature (24)..(24): s = c or g
  misc_feature (26)..(26): b = c, g or t
  misc_feature (28)..(28): m = a or c
  misc_feature (29)..(29): r = a or g
  misc_feature (36)..(36): s = c or g
  misc_feature (37)..(37): m = a or c
gtctcggaggttccggtgtggcwsgbcmrgtgcaasmatgtggctgcactgggtcgggagatg

SEQ ID NO: 169 - DNA, 51 bp, Artificial Sequence; identical to SEQ ID NO: 162
  mutagenesis primer

SEQ ID NO: 170 - DNA, 52 bp, Artificial Sequence; identical to SEQ ID NO: 163
  mutagenesis primer

SEQ ID NO: 171 - DNA, 25 bp, Artificial Sequence
  mutagenesis primer
caccggaacctccgagacttccgtt

SEQ ID NO: 172 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcacttgtatattttttgcgacgttatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 173 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcacttgtatattttttgcgacgttgtcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 174 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcacttgtatatttttagcgacattatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 175 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcacttgtatatttttaccgacgttctcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 176 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcacttgtatgtttttgccgacattatcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 177 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcacttgtatgtttttgccgacgttatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 178 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcacttgtatgtttttggcgacgttatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 179 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcacttgtatgttttttccgacgttatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 180 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcacttgtatgtttttagcgacgttctcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 181 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcagctcatcatcttttccgacatcatcgagctcccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 182 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcagttgtatattttttgcgacattatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 183 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcagttgtatattttttgcgacgttctcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 184 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcagttgtatatttttggcgacgttatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 185 - DNA, 2601 bp, Artificial Sequence
  PtIP-83 polypeptide variant encoding sequence
atggctctcgtggattacggcaagcttttcgaggatctgaaccagataagcatgggtgtactggatcggatagagttttcagaggtgatggtgatccacaggatgtatgtgaggctagctgatctgaatgtggggcagctcgagggagccgagaaagtgaagcagttgtatatttttagcgacattatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 186 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcagttgtatgttttttgcgacattctcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 187 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcagttgtatgtttttagcgacattctcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 188 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcagttgtatgtttttagcgacgttctcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 189 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttctatatctttgccgacatcgtcgagctcccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 190 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttctatatcttttccgacatcatcgagctcccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 191 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttctatgtctttagcgacatcgtcgagctcccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 192 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcctcgtcatcttgggcgacatcatcgtggtcccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 193 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatatttttgccgacattatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 194 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatattttttgcgacattatcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 195 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatattttttgcgacattgtcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 196 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatatttttggcgacattatcgagctaccagtcgtggaatggcggtggccggcgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 197 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatatttttggcgacgttatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 198 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatattttttccgacattatcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 199 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatatttttagcgacattctcgagctaccagtcgtggaatggcggtggccgccgcaaataccgggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 200 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctagagggagccgagaaagtgaagcgcttgtatatttttagcgacgttatcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 201 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatatttttaccgacgttatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 202 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatgttttttgcgacattatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 203 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgttttttgcgacattatcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 204 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatgtttttggcgacattgtcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 205 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatgtttttggcgacgttgtcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 206 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatgtttttagcgacattatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 207 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatgttttttccgacattgtcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 208 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatgttttttccgacgttatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 209 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatgtttttaccgacgttatcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 210 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatgtttttaccgacgttgtcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 211 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgatgcacttgtatatttttgccgacgttatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 212 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgatgcagttgtatattttttgcgacattctcgagctaccagtcgtggaatggcggtggccgacgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 213 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgatgcgcttgtatatttttgccgacgttgtcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 214 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgatgcgcttgtatattttttgcgacgttatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 215 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgatgcgcttgtatgttttttgcgacattatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 216 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgatgcggttgtatgttttttgcgacattctcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 217 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgatgcggttgtatgtttttagcgacattatcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 218 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcacttgtatatttttgccgacattatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 219 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcacttgtatatttttgccgacgttgtcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 220 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcacttgtatattttttgcgacgttatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 221 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcacttgtatattttttccgacgttatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 222 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcacttgtatatttttagcgacgttgtcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 223 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcacttgtatgtttttaccgacgttctcgagctaccagtcgtggaatggcggtggccaccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 224 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcagttgtatattttttgcgacgttatcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 225 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcagttgtatatttttagcgacgttgtcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 226 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcagttgtatgttttttgcgacgttctcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 227 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcggttgtatatttttgccgacattctcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 228 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcggttgtatatttttgccgacattgtcgagctaccagtcgtggaatggcggtggccggcgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 229 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcgcttgtatatttttggcgacattgtcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 230 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcgcttgtatatttttaccgacattatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 231 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcgcttgtatgtttttgccgacattatcgacctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 232 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcggttgtatgtttttgccgacattgtcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 233 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcgcttgtatgttttttgcgacgttgtcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 234 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcggttgtatgtttttaccgacattatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 235 - DNA, 2601 bp, Artificial Sequence
  PtIP-83 polypeptide variant encoding sequence
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcggttgtatgtttttaccgacgttctcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 236 - protein, 867 aa, Artificial Sequence
  PtIP-83 polypeptide variant
MALVDYGKLFEDLNQISMGVLDRVEFSEVMVIHRMYVRLADLNVGQLEGAEKVKHLYIFCDVIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 237 - protein, 867 aa, Artificial Sequence
  PtIP-83 polypeptide variant
MALVDYGKLFEDLNQISMGVLDRVEFSEVMVIHRMYVRLADLNVGQLEGAEKVKHLYIFCDVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 238 - protein, 867 aa, Artificial Sequence
  PtIP-83 polypeptide variant
MALVDYGKLFEDLNQISMGVLDRVEFSEVMVIHRMYVRLADLNVGQLEGAEKVKHLYIFSDIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 239 - protein, 867 aa, Artificial Sequence
  PtIP-83 polypeptide variant
MALVDYGKLFEDLNQISMGVLDRVEFSEVMVIHRMYVRLADLNVGQLEGAEKVKHLYIFTDVLELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 240 - protein, 867 aa, Artificial Sequence
  PtIP-83 polypeptide variant
MALVDYGKLFEDLNQISMGVLDRVEFSEVMVIHRMYVRLADLNVGQLEGAEKVKHLYVFADIIVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 241 - protein, 867 aa, Artificial Sequence
  PtIP-83 polypeptide variant
MALVDYGKLFEDLNQISMGVLDRVEFSEVMVIHRMYVRLADLNVGQLEGAEKVKHLYVFADVIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 242 - protein, 867 aa, Artificial Sequence
  PtIP-83 polypeptide variant
MALVDYGKLFEDLNQISMGVLDRVEFSEVMVIHRMYVRLADLNVGQLEGAEKVKHLYVFGDVIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 243 - protein, 867 aa, Artificial Sequence
  PtIP-83 polypeptide variant
MALVDYGKLFEDLNQISMGVLDRVEFSEVMVIHRMYVRLADLNVGQLEGAEKVKHLYVFSDVIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 244 - protein, 867 aa, Artificial Sequence
  PtIP-83 polypeptide variant
MALVDYGKLFEDLNQISMGVLDRVEFSEVMVIHRMYVRLADLNVGQLEGAEKVKHLYVFSDVLVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 245 - protein, 867 aa, Artificial Sequence
  PtIP-83 polypeptide variant
MALVDYGKLFEDLNQISMGVLDRVEFSEVMVIHRMYVRLADLNVGQLEGAEKVKQLIIFSDIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 246 - protein, 867 aa, Artificial Sequence
  PtIP-83 polypeptide variant
MALVDYGKLFEDLNQISMGVLDRVEFSEVMVIHRMYVRLADLNVGQLEGAEKVKQLYIFCDIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 247 - protein, 867 aa, Artificial Sequence
  PtIP-83 polypeptide variant
MALVDYGKLFEDLNQISMGVLDRVEFSEVMVIHRMYVRLADLNVGQLEGAEKVKQLYIFCDVLELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 248 - protein, 867 aa, Artificial Sequence
  PtIP-83 polypeptide variant
MALVDYGKLFEDLNQISMGVLDRVEFSEVMVIHRMYVRLADLNVGQLEGAEKVKQLYIFGDVIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 249 - protein, 867 aa, Artificial Sequence
  PtIP-83 polypeptide variant
MALVDYGKLFEDLNQISMGVLDRIEFSEVMVIHRMYVRLADLNVGQLEGAEKVKQLYIFSDIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 250 - protein, 867 aa, Artificial Sequence
  PtIP-83 polypeptide variant
MALVDYGKLFEDLNQISMGVLDRVEFSEVMVIHRMYVRLADLNVGQLEGAEKVKQLYVFCDILELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 251 - protein, 867 aa, Artificial Sequence
  PtIP-83 polypeptide variant
MALVDYGKLFEDLNQISMGVLDRVEFSEVMVIHRMYVRLADLNVGQLEGAEKVKQLYVFSDILELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 252 - protein, 867 aa, Artificial Sequence
  PtIP-83 polypeptide variant
MALVDYGKLFEDLNQISMGVLDRVEFSEVMVIHRMYVRLADLNVGQLEGAEKVKQLYVFSDVLVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 253 - protein, 867 aa, Artificial Sequence
  PtIP-83 polypeptide variant
MALVDYGKLFEDLNQISMGVLDRVEFSEVMVIHRMYVRLADLNVGQLEGAEKVKRFYIFADIVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 254 - protein, 867 aa, Artificial Sequence
  PtIP-83 polypeptide variant
MALVDYGKLFEDLNQISMGVLDRVEFSEVMVIHRMYVRLADLNVGQLEGAEKVKRFYIFSDIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 255 - protein, 867 aa, Artificial Sequence
  PtIP-83 polypeptide variant
MALVDYGKLFEDLNQISMGVLDRVEFSEVMVIHRMYVRLADLNVGQLEGAEKVKRFYVFSDIVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 256 - protein, 867 aa, Artificial Sequence
  PtIP-83 polypeptide variant
MALVDYGKLFEDLNQISMGVLDRVEFSEVMVIHRMYVRLADLNVGQLEGAEKVKRLVILGDIIVVPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 257 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYIFADIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 258 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYIFCDIIVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 259 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYIFCDIVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 260 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYIFGDIIELPVVEWRWPAQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 261 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYIFGDVIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 262 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYIFSDIIVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 263 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYIFSDILELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 264 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYIFSDVIVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 265 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYIFTDVIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 266 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFCDIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 267 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFCDIIVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 268 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFGDIVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 269 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFGDVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 270 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFSDIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 271 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFSDIVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 272 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFSDVIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 273 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFTDVIVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 274 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFTDVVVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 275 - protein, 867 aa, Artificial Sequence
  PtIP-83 polypeptide variant
MALVDYGKLFEDLNQISMGVLDRVEFSEVMVIHRMYVRLADLNVGQLEGAEKVMHLYIFADVIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 276 - protein, 867 aa, Artificial Sequence
  PtIP-83 polypeptide variant
MALVDYGKLFEDLNQISMGVLDRVEFSEVMVIHRMYVRLADLNVGQLEGAEKVMQLYIFCDILELPVVEWRWPTQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 277 - protein, 867 aa, Artificial Sequence
  PtIP-83 polypeptide variant
MALVDYGKLFEDLNQISMGVLDRVEFSEVMVIHRMYVRLADLNVGQLEGAEKVMRLYIFADVVVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 278 - protein, 867 aa, Artificial Sequence
  PtIP-83 polypeptide variant
MALVDYGKLFEDLNQISMGVLDRVEFSEVMVIHRMYVRLADLNVGQLEGAEKVMRLYIFCDVIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 279 - protein, 867 aa, Artificial Sequence
  PtIP-83 polypeptide variant
MALVDYGKLFEDLNQISMGVLDRVEFSEVMVIHRMYVRLADLNVGQLEGAEKVMRLYVFCDIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 280 - protein, 867 aa, Artificial Sequence
  PtIP-83 polypeptide variant
MALVDYGKLFEDLNQISMGVLDRVEFSEVMVIHRMYVRLADLNVGQLEGAEKVMRLYVFCDILVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 281 - protein, 867 aa, Artificial Sequence
  PtIP-83 polypeptide variant
MALVDYGKLFEDLNQISMGVLDRVEFSEVMVIHRMYVRLADLNVGQLEGAEKVMRLYVFSDIIVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 282 - protein, 867 aa, Artificial Sequence
  PtIP-83 polypeptide variant
MALVDYGKLFEDLNQISMGVLDRVEFSEVMVIHRMYVRLADLNVGQLEGAEKVRHLYIFADIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 283 - protein, 867 aa, Artificial Sequence
  PtIP-83 polypeptide variant
MALVDYGKLFEDLNQISMGVLDRVEFSEVMVIHRMYVRLADLNVGQLEGAEKVRHLYIFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 284 - protein, 867 aa, Artificial Sequence
  PtIP-83 polypeptide variant
MALVDYGKLFEDLNQISMGVLDRVEFSEVMVIHRMYVRLADLNVGQLEGAEKVRHLYIFCDVIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 285 - protein, 867 aa, Artificial Sequence
  PtIP-83 polypeptide variant
MALVDYGKLFEDLNQISMGVLDRVEFSEVMVIHRMYVRLADLNVGQLEGAEKVRHLYIFSDVIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 286 - protein, 867 aa, Artificial Sequence
  PtIP-83 polypeptide variant
MALVDYGKLFEDLNQISMGVLDRVEFSEVMVIHRMYVRLADLNVGQLEGAEKVRHLYIFSDVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 287 - protein, 867 aa, Artificial Sequence
  PtIP-83 polypeptide variant
MALVDYGKLFEDLNQISMGVLDRVEFSEVMVIHRMYVRLADLNVGQLEGAEKVRHLYVFTDVLELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 288 - protein, 867 aa, Artificial Sequence
  PtIP-83 polypeptide variant
MALVDYGKLFEDLNQISMGVLDRVEFSEVMVIHRMYVRLADLNVGQLEGAEKVRQLYIFCDVIVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 289 - protein, 867 aa, Artificial Sequence
  PtIP-83 polypeptide variant
MALVDYGKLFEDLNQISMGVLDRVEFSEVMVIHRMYVRLADLNVGQLEGAEKVRQLYIFSDVVVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 290 - protein, 867 aa, Artificial Sequence
  PtIP-83 polypeptide variant
MALVDYGKLFEDLNQISMGVLDRVEFSEVMVIHRMYVRLADLNVGQLEGAEKVRQLYVFCDVLVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 291 - protein, 867 aa, Artificial Sequence
  PtIP-83 polypeptide variant
MALVDYGKLFEDLNQISMGVLDRVEFSEVMVIHRMYVRLADLNVGQLEGAEKVRRLYIFADILELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 292 - protein, 867 aa, Artificial Sequence
  PtIP-83 polypeptide variant
MALVDYGKLFEDLNQISMGVLDRVEFSEVMVIHRMYVRLADLNVGQLEGAEKVRRLYIFADIVELPVVEWRWPAQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 293 - protein, 867 aa, Artificial Sequence
  PtIP-83 polypeptide variant
MALVDYGKLFEDLNQISMGVLDRVEFSEVMVIHRMYVRLADLNVGQLEGAEKVRRLYIFGDIVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 294 - protein, 867 aa, Artificial Sequence
  PtIP-83 polypeptide variant
MALVDYGKLFEDLNQISMGVLDRVEFSEVMVIHRMYVRLADLNVGQLEGAEKVRRLYIFTDIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 295 - protein, 867 aa, Artificial Sequence
  PtIP-83 polypeptide variant
MALVDYGKLFEDLNQISMGVLDRVEFSEVMVIHRMYVRLADLNVGQLEGAEKVRRLYVFADIIDLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 296 - protein, 867 aa, Artificial Sequence
  PtIP-83 polypeptide variant
MALVDYGKLFEDLNQISMGVLDRVEFSEVMVIHRMYVRLADLNVGQLEGAEKVRRLYVFADIVVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 297 - protein, 867 aa, Artificial Sequence
  PtIP-83 polypeptide variant
MALVDYGKLFEDLNQISMGVLDRVEFSEVMVIHRMYVRLADLNVGQLEGAEKVRRLYVFCDVVVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 298 - protein, 867 aa, Artificial Sequence
  PtIP-83 polypeptide variant
MALVDYGKLFEDLNQISMGVLDRVEFSEVMVIHRMYVRLADLNVGQLEGAEKVRRLYVFTDIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 299 - protein, 867 aa, Artificial Sequence
  PtIP-83 polypeptide variant
MALVDYGKLFEDLNQISMGVLDRVEFSEVMVIHRMYVRLADLNVGQLEGAEKVRRLYVFTDVLVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 300 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggcacgcccggtgcaagtccgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 301 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggcacggcaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 302 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatcgccaagtgcaagtgcgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 303 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatcgccaagtgcaagagcgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 304 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatcggcaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 305 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatcggcaagtgcaagtccgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 306 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatcggcaagtgcaacaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 307 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatcgtcaagtgcaagagcgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 308 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggctggccaggtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 309 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggctcgccaggtgcaagagcgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 310 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggctgggccggtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 311 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggctgggcaggtgcaagagcgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 312 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggctggtcaagtgcaagtgcgtggctgcactgggtcgagagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 313 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtgtctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 314 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatgggccggtgcaagtccgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 315 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatggtcaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 316 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatggtcaagtgcaagagcgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 317 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatggtcaggtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 318 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggcaggccaggtgcaagcatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 319 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaatgacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggcaggccaggtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 320 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggcagggcaggtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 321 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggcaggtcaggtgcaagtccgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 322 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaggtgcaagaatgtggctgcactgggtcgggagatgagcatcgcggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 323 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggaggggcaagtgcaagagcgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 324 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggaggggcaggtgcaagaccgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 325 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagcgccaggtgcaagagcgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 326 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagcgtcaagtgcaagcatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 327 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggacgggccggtgcaagaccgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 328 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggaccggcaggtgcaaccatgtggctgcactgggtcaggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 329 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggacggtcaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 330 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggaccgtcaagtgcaagagcgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 331 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggaccgtcaggtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 332 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggcccggtgcaagcatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 333 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatcggccggtgcaagtccgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 334 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWHARCKSVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 335 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWHGKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 336 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWIAKCKCVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 337 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWIAKCKSVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 338 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWIGKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 339 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWIGKCKSVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 340 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWIGKCNNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 341 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWIVKCKSVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 342 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWLARCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 343 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWLARCKSVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 344 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWLGRCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 345 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWLGRCKSVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 346 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWLVKCKCVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 347 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVSAVKDLVDSLEQVGQIVDAPVMPELPSEADWSIFVNEVEAVAEGMPTEVSEVPVWMAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 348 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWMGRCKSVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 349 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWMVKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 350 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWMVKCKSVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 351 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWMVRCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 352 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWQARCKHVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 353 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVNDLVDSLEQVGQIVDAPVMPELPSEADWSIFVNEVEAVAEGMPTEVSEVPVWQARCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 354 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWQGRCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 355 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWQVRCKSVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 356 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRARCKNVAALGREMSIAAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 357 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRGKCKSVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 358 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRGRCKTVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 359 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWSARCKSVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 360 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWSVKCKHVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 361 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWTGRCKTVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 362 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWTGRCNHVAALGQEMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 363 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWTVKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 364 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWTVKCKSVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 365 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWTVRCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 366 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRARCKHVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 367 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWIGRCKSVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 368 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcacttgtatatttttaccgacgttctcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggttcatttttgtgaacgaggtggaggccgtggcagagggcatgccaacggaagtctcggaggttccggtgtggcacggcaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 369 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcacttgtatatttttaccgacgttctcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggctggccaggtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 370 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcacttgtatatttttaccgacgttctcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggcaggccaggtgcaagcatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 371 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcacttgtatgtttttgccgacgttatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggcaggccaggtgcaagcatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 372 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcacttgtatgtttttgccgacgttatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaggtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 373 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcagttgtatattttttgcgacgttctcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggcaggccaggtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 374 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttctatatctttgccgacatcgtcgagctcccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatcggcaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 375 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttctatatctttgccgacatcgtcgagctcccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggacggtcaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 376 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatatttttgccgacattatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatggtcaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 377 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatatttttgccgacattatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggcaggccaggtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 378 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgaggaagtgaagcgcttgtatatttttgccgacattatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaatgacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggaggggcaagtgcaagagcgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 379 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatatttttgccgacattatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggaggggccggtgcaagaccgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 380 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatatttttaccgacgttatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatcggcaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 381 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatgttttttgcgacattatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggctggccaggtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 382 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatgtttttagcgacattatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatcggcaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 383 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatgtttttagcgacattatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggaggggccggtgcaagaccgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 384 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatgttttttccgacgttatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggaggggcaagtgcaagagcgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 385 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcgcttgtatgttttttccgacgttatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggtcaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 386 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgatgcggttgtatatttttgccgacgttgtcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggaggggcaagtgcaagagcgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 387 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcacttgtatattttttgcgacgttatcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatcggcaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 388 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcacttgtatatttttagcgacgttgtcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatggtcaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 389 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcacttgtatatttttagcgacgttgtcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaatgacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggaggggcaagtgcaagagcgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 390 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcagttgtatgttttttgcgacgttctcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggcacggcaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 391 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcagttgtatgttttttgcgacgttctcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggctgggccggtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 392 - DNA, 2601 bp, Artificial Sequence
  PtIP-83 polypeptide variant encoding polynucleotide
atagctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcagttgtatgttttttgcgacgttctcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggaggggcaagtgcaagagcgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 393 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcggttgtatatttttgccgacattctcgagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatggtcaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 394 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcgcttgtatgttttttgcgacgttgtcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaggtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 395 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcggttgtatgtttttaccgacgttctcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggatcggcaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 396 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcggttgtatgtttttaccgacgttctcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaggtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 397 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaggcggttgtatgtttttaccgacgttctcgtgctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggacggtcaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 398 - protein, 867 aa, Artificial Sequence
  PtIP-83 polypeptide variant
MALVDYGKLFEDLNQISMGVLDRVEFSEVMVIHRMYVRLADLNVGQLEGAEKVKHLYIFTDVLELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWFIFVNEVEAVAEGMPTEVSEVPVWHGKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 399 - protein, 867 aa, Artificial Sequence
  PtIP-83 polypeptide variant
MALVDYGKLFEDLNQISMGVLDRVEFSEVMVIHRMYVRLADLNVGQLEGAEKVKHLYIFTDVLELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWLARCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 400 - protein, 867 aa, Artificial Sequence
  PtIP-83 polypeptide variant
MALVDYGKLFEDLNQISMGVLDRVEFSEVMVIHRMYVRLADLNVGQLEGAEKVKHLYIFTDVLELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWQARCKHVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 401 - protein, 867 aa, Artificial Sequence
  PtIP-83 polypeptide variant
MALVDYGKLFEDLNQISMGVLDRVEFSEVMVIHRMYVRLADLNVGQLEGAEKVKHLYVFADVIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWQARCKHVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 402 - protein, 867 aa, Artificial Sequence
  PtIP-83 polypeptide variant
MALVDYGKLFEDLNQISMGVLDRVEFSEVMVIHRMYVRLADLNVGQLEGAEKVKHLYVFADVIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRARCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 403 - protein, 867 aa, Artificial Sequence
  PtIP-83 polypeptide variant
MALVDYGKLFEDLNQISMGVLDRVEFSEVMVIHRMYVRLADLNVGQLEGAEKVKQLYIFCDVLELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWQARCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 404 - protein, 867 aa, Artificial Sequence
  PtIP-83 polypeptide variant
MALVDYGKLFEDLNQISMGVLDRVEFSEVMVIHRMYVRLADLNVGQLEGAEKVKRFYIFADIVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWIGKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 405 - protein, 867 aa, Artificial Sequence
  PtIP-83 polypeptide variant
MALVDYGKLFEDLNQISMGVLDRVEFSEVMVIHRMYVRLADLNVGQLEGAEKVKRFYIFADIVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWTVKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 406 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYIFADIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWMVKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 407 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYIFADIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWQARCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 408 - protein, 867 aa, Artificial Sequence
  PtIP-83 polypeptide variant
MALVDYGKLFEDLNQISMGVLDRVEFSEVMVIHRMYVRLADLNVGQLEGAEEVKRLYIFADIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVNDLVDSLEQVGQIVDAPVMPELPSEADWSIFVNEVEAVAEGMPTEVSEVPVWRGKCKSVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 409 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYIFADIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRGRCKTVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 410 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYIFTDVIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWIGKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 411 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFCDIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWLARCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 412 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFSDIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWIGKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 413 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFSDIIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRGRCKTVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 414 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFSDVIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRGKCKSVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 415 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFSDVIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRVKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 416 - protein, 867 aa, Artificial Sequence
  PtIP-83 polypeptide variant
MALVDYGKLFEDLNQISMGVLDRVEFSEVMVIHRMYVRLADLNVGQLEGAEKVMRLYIFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRGKCKSVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 417 - protein, 867 aa, Artificial Sequence
  PtIP-83 polypeptide variant
MALVDYGKLFEDLNQISMGVLDRVEFSEVMVIHRMYVRLADLNVGQLEGAEKVRHLYIFCDVIELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWIGKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 418 - protein, 867 aa, Artificial Sequence
  PtIP-83 polypeptide variant
MALVDYGKLFEDLNQISMGVLDRVEFSEVMVIHRMYVRLADLNVGQLEGAEKVRHLYIFSDVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWMVKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 419 - protein, 867 aa, Artificial Sequence
  PtIP-83 polypeptide variant
MALVDYGKLFEDLNQISMGVLDRVEFSEVMVIHRMYVRLADLNVGQLEGAEKVRHLYIFSDVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVNDLVDSLEQVGQIVDAPVMPELPSEADWSIFVNEVEAVAEGMPTEVSEVPVWRGKCKSVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 420 - protein, 867 aa, Artificial Sequence
  PtIP-83 polypeptide variant
MALVDYGKLFEDLNQISMGVLDRVEFSEVMVIHRMYVRLADLNVGQLEGAEKVRQLYVFCDVLVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWHGKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 421 - protein, 867 aa, Artificial Sequence
  PtIP-83 polypeptide variant
MALVDYGKLFEDLNQISMGVLDRVEFSEVMVIHRMYVRLADLNVGQLEGAEKVRQLYVFCDVLVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWLGRCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 422 - protein, 867 aa, Artificial Sequence
  PtIP-83 polypeptide variant
IALVDYGKLFEDLNQISMGVLDRVEFSEVMVIHRMYVRLADLNVGQLEGAEKVRQLYVFCDVLVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRGKCKSVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 423 - protein, 867 aa, Artificial Sequence
  PtIP-83 polypeptide variant
MALVDYGKLFEDLNQISMGVLDRVEFSEVMVIHRMYVRLADLNVGQLEGAEKVRRLYIFADILELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWMVKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 424 - protein, 867 aa, Artificial Sequence
  PtIP-83 polypeptide variant
MALVDYGKLFEDLNQISMGVLDRVEFSEVMVIHRMYVRLADLNVGQLEGAEKVRRLYVFCDVVVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRARCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 425 - protein, 867 aa, Artificial Sequence
  PtIP-83 polypeptide variant
MALVDYGKLFEDLNQISMGVLDRVEFSEVMVIHRMYVRLADLNVGQLEGAEKVRRLYVFTDVLVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWIGKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 426 - protein, 867 aa, Artificial Sequence
  PtIP-83 polypeptide variant
MALVDYGKLFEDLNQISMGVLDRVEFSEVMVIHRMYVRLADLNVGQLEGAEKVRRLYVFTDVLVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRARCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 427 - protein, 867 aa, Artificial Sequence
  PtIP-83 polypeptide variant
MALVDYGKLFEDLNQISMGVLDRVEFSEVMVIHRMYVRLADLNVGQLEGAEKVRRLYVFTDVLVLPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWTVKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 428 - DNA, 2556 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcagaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatggctcgaagccaggcagacaggctggccgcaattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 429 - DNA, 2559 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagagcagctggaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgaaggaggccagcggtattggtggtgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 430 - DNA, 2559 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcagattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtcgggagatgagcatcacggcagtacagatgtcggagctgcagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 431 - DNA, 2556 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaagctggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 432 - DNA, 2553 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgtttgcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcagcggagaataaaggattagcctttcccacagctacagctcccgactccaccactgagattgccatcactttccatgttacggccattagacaaattgactggcggcaagaggaggag

SEQ ID NO: 433 - DNA, 2563 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtcaaggcatgtcatccgtcacccgatgttgtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagagcagctggaggctgtgatggaggttgtggctgctgtgaaggacctcgtggattcattggaccaggtaggtcagattgtggacgcaccggtgatgccggaattgccctcagaggcggactggtccatttttgtgaacgaggtggaggccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagagtagc

SEQ ID NO: 434 - DNA, 2559 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagaaagtgaagcggttgtatgtgttggcggacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 435 - DNA, 2559 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtatgtgaggctagctgatctgaatgtgggggagctccccggagccgagaaagtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggcgtggaaggccaagtgcaagaatgtggctgcactgggtagggagatgagcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgaaggaggccagcggtattggtggtgagattatccaccagcctaccacccagacggggaccatttacatcctcctgcagggctccactgtcttccatgatcgcagaagggaggaggtgatgacctttcaggcagcggttccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 436 - DNA, 2556 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgctgggcatgcaaaccagcgtgcacattgcggagctagtgaaggcatgttacccgtcaccagaattagtgagcgctgtaggggtgcacgtgaattggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcagctcaagttattcattgcccaaaaccaaatccttggcagctatttgctgcagcagaacagggcatttgctgagagggagctgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggccagcggtattggtggtgagattatccaccagcctgccacccagactgggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 437 - DNA, 2502 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctatgttcacagcttgcgctgcagatgctgcagcgcaagctgtgagcatagcaggtcaggcggcgcaaggtctgcgaagggtggtggaaattctagagcagctggaggctgtgatggaggttgtggctgctataaagcaccttgtggatgctctggaccaggtaagtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 438 - DNA, 2559 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcagaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggggctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 439 - DNA, 2559 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagaaagtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtagggagatgtgcatcacggcagaacagatttcccagctccagtatgacatctgggtgcaaggcttgttgcgggatatagctcaaagccacgcagaccggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcagcggagaataaaggattagcctttcccacagctacagctcccgactccaccactgagattgccatcactttccatgttacggccattagacaaattgactggcggcaagaggaggag

SEQ ID NO: 440 - DNA, 2559 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcatattgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggagcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 441 - DNA, 2559 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggaaggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacactggagaagccactcttacgaacgagccctcggaacagtttgccaacacattcatgcagatgacaccgttcactcactggaggcttcgtctgtctgcgtccgcagcggagaataaaggattagcctttcccacagctacagctcccgactccaccactgagattgccatcactttccatgttacggccattagacaaattgactggcggcaagaggaggag

SEQ ID NO: 442 - DNA, 2559 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtggggcagctcgagggagccgagagggtgaagcggttgtatgtgtttgcggacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcaaccaaatggcccaagtagcacaaaactacgaccgagaattcaagcaattcaaattattcatcatccaaaatcaaatccttggcagctatttgctgcagcagaacagggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggtccatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaagctggcatgtccagcttcccttccagctggtctcgcgtccgtattcggcacctggagatgcactttgtgaaggaggccagcggtattggtggtgagattatccaccagcctgccacccagacggggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 443 - DNA, 2556 bp, Artificial Sequence
  PtIP-83 polypeptide variant encoding polynucleotide
atggattacagcacgctttacagggatctgaaccagataagcatgcccctggatcgggtagagttctcagaggtgatggtgatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaccgcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggagcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggtgtggagggccaagtgcaagaatgtggctgcactgggtagggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 444 - DNA, 2556 bp, Artificial Sequence; identical to SEQ ID NO: 431
  PtIP-83 polypeptide variant encoding polynucleotide

SEQ ID NO: 445 - DNA, 2556 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgtttgcggacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacaagttcatgcagatgacacccttcacccgttggaggcttcgtctgtctgcgtccgcaaaagagaatgtaggattagcctttcccacggctacagcacttgactccaccactgagattgccatcactttccatgttacggccattagacaaattgactggcggcaagaggaggag

SEQ ID NO: 446 - DNA, 2559 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggagcacctgaactggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 447 - DNA, 2556 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaataggcaagttgcgaacgccctctttgccgttcttagcgctgtagctcagattgggcttgcattccttacggctggtgcaacggctcctggggctgcagcatctgcagcgcaagctgtgaacatagccggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcacgacgaagag

SEQ ID NO: 448 - DNA, 2559 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacagggcatttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 449 - DNA, 2556 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtcaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcggaggcggactggagtatttttgtgaatgagattgaagccgtggcagaggggatgccgacggaagtctcggaggttccggtgtggagggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacaccggcgactccactctcacaaacgaaccctctgaacagtttgccaacaagttcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 450 - DNA, 2556 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtggggcagctcgagggagccgagaaagtgaagcggttgtatgtgttggcagacgtggtggagctcgcaacatttgcgcatccacagttgcttaatacgcggatgccaggatcggtgacggtgatcatattgtgtcgtcttcttcaatggccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccacctatgccagacatgccctcggaggcgggctggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 451 - DNA, 2559 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcttgttgcgggatatagctcaaagccacgcagaccggctggcagcgattcaacctgctaatcttaccaactatttggagatggcaatacagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccggcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 452 - DNA, 2595 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 453 - DNA, 2598 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaagggaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccgcctatgccagacatgccctcggaggcggactggagtatttttgtgaatgagattgaagccgtggcagaggggatgccgacggaagtctcggaggttccggcgtggaaggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggcaatacagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcagcggagaataaaggattagcctttcccacagctacagctcccgactccaccactgagattgccatcactttccatgttacggccattagacaaattgactggcggcaagaggaggag

SEQ ID NO: 454 - DNA, 2553 bp, Artificial Sequence; identical to SEQ ID NO: 432
  PtIP-83 polypeptide variant encoding polynucleotide

SEQ ID NO: 455 - DNA, 2559 bp, Artificial Sequence; identical to SEQ ID NO: 442
  PtIP-83 polypeptide variant encoding polynucleotide

SEQ ID NO: 456 - DNA, 2556 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagaggggatgccgacggaagtctcggaggttccggtgtggagggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 457 - DNA, 2556 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtatgtgaggctagctgatctgaatgtggggcagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtcaaggcatgtcatccgtcacccgatgttgtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggggctgcagcatctgcagcgcaagctgtgaacatagccggtcaagcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggaaggccaagtgcaagaatgtggctgcactgggtcgggagatgagcatcacggcagtacagatgtcggagctgcagtatgacatctgggtgcaaggcatgatgcgggatatagctcaaagccacgcagaccggctggcagcgattcaacctgctaatcttaccaactatttggagatggcaatacagatggatatgcggactacgaggatactgatagggctcctcaacatattgcgcatccagaatgcggcgctcaggtacgagtatcttctaatgcccacggagctcacaacatggccactgggtatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcagcggagaataaaggattagcctttcccacagctacagctcccgactccaccactgagattgccatcactttccatgttacggccattagacaaattgactggcggcacgacgaagag

SEQ ID NO: 458 - DNA, 2556 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgtttgtggacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccccagctgcaatacagaatgtacggtagcctcatcaaccaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacggctacagcacttgactccactacccagattgtcatcactttccatgttacggccattagacaaattgactggcggcacgaggaggag

SEQ ID NO: 459 - DNA, 2569 bp, Artificial Sequence
  PtIP-83 polypeptide variant encoding polynucleotide
atggctctcgtggattacggcaagcttttcgaggatctgaaccagataagcatgcccctggatcgggtagagttctcagaggtgatggtaatccacaggatgtacttgaggttatctgatctgaatgtgggggagctccccggagccgagagggtgaagcggttgtatgtgtttgcggacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggacgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtggtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagagtagc

SEQ ID NO: 460 - DNA, 2556 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgtcatccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcatgctgctgtcatttctcaaagaagggaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttagcgctgtagctcagattgggcttgcattccttacggctggtgcaacggctcctggagctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggcttcgtctgtccgcgtccgcaaaagagaatgcaggattagcctttcccacggctacagcacttgactccactacccagattgtcatcactttccatgttacggccatcagacaaattgactggcggcacgacgaagag

SEQ ID NO: 461 - DNA, 2556 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcagcatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctccagtatgacatctgggtgcaaggcttgttgcgggatatagctcaaagccacgcagaccggctggcagcgattcaacctgctaatcttaccaactatttggagatggcaatacagatggatatgcggactacgaggatgctgctggggctcctcaacataatgcgcatccagaatgcggcacttatgtatgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggaatttgagattcctgtgcaaggtggcatgtccagtttcccttccagctggactcgagtgcggattcggcacctggagatgcactttgtgcaggaggcgagcggtggcggtgagattatccaccagcctaccacccagactgggaccgtttacatccttctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacggctacagcacttgactccactacccagattgtcatcactttccatgttacggccattagacaaattgactggcggcaagaggaggag

SEQ ID NO: 462 - DNA, 2559 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcacccgatgttgtgagcgctgtaggggagcacctgaactggctcaacgaagtcttgctccgagttgtccagaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaaggcaggagttggacgacgccatcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccgactggcagcgattcaacctgctaatcttaccaactatttggagatggcaatacagatggatatgcggactacgaggatactgatagggctcctcaacataatgcgcatccagaatgcggcacttatgtatgagtaccttctaacgcccacggagctcacaacatggccactgggtatggataccgtgggtgacttgctcatcgcgcaggagaatgctgcactgataggattaatgcagctagggccctcatctgatttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcaaaagagaatgcaggattagcctttcccacggctacagcacttgactccactacccagattgtcatcactttccatgttacggccatcagacaaattgactggcggcaagaggaggag

SEQ ID NO: 463 - DNA, 2562 bp, Artificial Sequence
  PtIP-83 polypeptide variant encoding polynucleotide
atggattacagcacgctttacagggatctgaaccagataagcatgggtgtactggatcgggtagagttttcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatgaagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaagtagcacaaaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgtggcgtcggcggggcaagctgtgagcatagcaggtcaggcggcgcaaggtctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgagaatggatactgtggccaacttgctcatcacgcacgagagtgctgcactgtcaggattagctcagttagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 464 - DNA, 2560 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgactgatcctaacatcttgctgggcatgcagacaacggtacacattgcggagctagtcaaggcatgtcatccgtcacccgatgttgtgagcgctgtaggggtgcacctgaactggctcaacaaactcttactcccacttaaggaatcgactcagttgcaaggaagcgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactacatggccactgggtatggataccgtgggtgacttgctcatcgtgcaggagaatgctgcactgataggattaatgcagctagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggccagcggtattggtggtgagattatccaccagcctaccacccagactgggaccgtttacatccttctgcagggctccactgtcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagagtagc

SEQ ID NO: 465 - DNA, 2556 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtaagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcaaccaaatggcccaagtagcacaaaactacgaccgagaattcaagcaattcaaattattcatcatccaaaatcaaatccttggcagctatttgctgcagcagaacagggcatttgctgacagagaggtgcagatggagagctttcattcagcggtcatttctcaaagaagggaggagttggacgacgccatcgctaagatggaccgactgagcttgcagatggaggcagagagtagtgcaatggagcaagccaaaaaggaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgagcatagcaggtcaggcggcgcaagctctgcgaagggtggtggaaattctagaggggctcgaggctgtgatggaggttgtggctgctgtgaaggacctcgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 466 - DNA, 2559 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacccgcggaccttaccaactatttggagatggctacccagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 467 - DNA, 2559 bp, Artificial Sequence; identical to SEQ ID NO: 462
  PtIP-83 polypeptide variant encoding polynucleotide

SEQ ID NO: 468 - DNA, 2560 bp, Artificial Sequence
  PtIP-83 polypeptide variant encoding polynucleotide
atggattacagcacgctttacagggatctgaaccagataagcatgcccctggatcgggtagagttctcagaggtgatggtgatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacagggcctttgctgacagagaggtgcagatggagagctttcattcagcggtcatttctcaaagaaggcaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggtccatttttgtgaacgaggtggaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggataccgtgggtgacttgctcatcacgcaggagaatgctgcactgataggattaatgcagctagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgaccgcagaagggaggaggtgatgacctttcaggcagcggttccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaagttgactggcggcacgacgaagagtagc

SEQ ID NO: 469 - DNA, 2556 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtggggcagctcgagggagccgagagggtgaagcggttgtatgtgtttgcggacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaagggaggagttggacaatacattcgcaaagatggaccgactgagcttgcagatggaggcagagagtagtgcaatggagcaagccaaaaaggaaatggacgaaggattgaggcagttccagaataggcaagttgcgaacgccctctttgctgttcttaaatctgtagctatgattgcgctcgcattcgtcacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatttcccagctccagtatgacatctgtgtgcaaggcatgatgcgggatatggctcgaagccaggcagacaggctggccgcaattcaacccgcggaccttaccaactatttggagatggctacccagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccgtttacatccttctgcagggttccactgtcttccatgatcgcagaagggaggaggtgatgacctttcaggcagcagttccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 470 - DNA, 2559 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagccaaaaaggaaatggacgaaggattgaagcagttccagaatgagcaagttgcaagggctgtgttcgctgttcttaaatctgtagctatgattgcgctcgcattcgtcacggctggtgcaacggctcctggggctgtggcgtcggcggggcaagctgtgagcatagcaggtcaggcggcgcaaggtctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccagacagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 471 - DNA, 2559 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagaattcaagcaattcaaattattcatcatccaaaatcaaatccttggcagctatttgctgcagcagaacagggcatttgctgagagggagctacagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggctcgcattcgtcacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagagggcatgccaacggaagtctcggaggttccggtgtggaaggccaagtgcaagaatgtggctgcactgggtagggagatgtgcatcacggcagtacagatgtcggagctgcagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacggctacagcacttgactccactacccagattgtcatcactttccatgttacggccatcagacaaattgactggcggcaagaggaggag

SEQ ID NO: 472 - DNA, 2556 bp, Artificial Sequence
  PtIP-83 polypeptide variant encoding polynucleotide
atggattacagcacgctttacagggatctgaaccagataagcatgcccctggatcgggtagagttctcagaggtgatggtaatccacaggatgtacttgaggttatctgatctgaatgtggggcagctcgagggagccgagaaagtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtacacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaagggaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagaggggatgccgacggaagtctcggaggttccggcgtggaaggccaagtgcaagaatgtggctgcactgggtcgggagatgagcatcacggcagaacagatttcccagctccagtatgacatctgggtgcaaggcttgttgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacaagttcatgcagatgacacccttcacccgttggaggcttcgtctgtctgcgtccgcagcggagaataaaggattagcctttcccacagctacagctcccgactccaccactgagattgccatcactttccatgttacggccattagacaaattgactggcggcaagaggaggag

SEQ ID NO: 473 - DNA, 2605 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaaggcaggagttggacgacgccatcgctaagatggaccgactgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatttcccagctccagtatgacatctgggtgcaaggcatgatgcgggatatggctcgaagtcaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtagtgaaaggcatacctgtgagcttgcttctagacggtggggattgggagtttgagattcctgtgcaagctggcatgtccagcttcccttccagctggtctcgcgtccggattcggcacctggagatgcactttgtgcaggaggccagcggtattggtggtgagattatccaccagcctgccacccagacggggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccattagacaaattgactggcggcacgatgaagagtagc

SEQ ID NO: 474 - DNA, 2605 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgactgagcttgcagatggaggaagaggacagagcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctataaagcaccttgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggaaggccaagtgcaagaatgtggctgcactgggtagggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaaggtggcatgtccagtttcccttccagctggactcgagtgcggattcggcacctggagatgcactttgtgaaggaggccagcggtattggtggtgagattatccaccagcctgccacccagaccgggaccgtttacatccttctgcagggttccactatcttccatgatcgcagaagggaggaggtgttgccttttcaggccgctgctccgctcaactaccattacgcgtaccgcctcgacactggagaagccactcttacgaacgagccctcggaacagtttgccaacacattcatgcagatgacacccttcacccgttggaggctacgtctgtctgcgtccgcagcggagaataaaggattagcctttcccacagctacagctcccgactccaccactgagattgccatcactttccatgttacggccatcagacaaattgactggcggcaagaggaggagtagc

SEQ ID NO: 475 - DNA, 2602 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcattcagcggtcatttctcaaagaagggaggagttggacaatacattcgcaaagatggaccgactgagcttgcagatggaggaagaggacagagcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggggctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggcttcgtctgtctgcgtccgcagcggagaataaaggattagcctttcccacagctacagctcccgactccaccactgagattgccatcactttccatgttacggccattagacaaattgactggcggcacgacgaagagtagc

SEQ ID NO: 476 - DNA, 2605 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcattcagcggtcatttctcaaagaaggcaggagttggacgacgccatcgctaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctatgattgcgctcgcattcgtcacggctggtgcaacggctcctggggctgtggcgtcggcggggcaagctgtgagcatagcaggtcaggcggcgcaaggtctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagaggggatgccgacggaagtctcggaggttccggtgtggaaggccaagtgcaagaatgtggctgcactgggtcgggagatgagcatcacggcagtacagatgtcggagctgcagtatgacatctgggtgcaaggcatgatgcgggatatggctcgaagccacgcagaccggctggcagcgattcaacctgctaatcttaccaactatttggagatggcaatacagatggatatgcggactacgaggatgctgctggggctcctcaacatattgcgcatccagaatgcggcgctcaggtacgagtatcttctaacgcccacggagctcacaacatggccactgggtatggataccgtgggtgacttgctcatcgcgcaggagaatgctgcactgataggattaatgcagctagggcccccatcggacttcacgagcaggcatgtagtgaaaggcatacctgtgagcttgcttctagacggtggggattgggaatttgagattcctgtgcaaggtggcatgtccagtttcccttccagctggtctcgcgtccgtattcggcacctggagatgcactttgtgaaggaggccagcggtattggtggtgagattatccaccagcctaccacccagactgggaccgtttacatccttctgcagggctccactgtcttccatgatcgcagaagggaggaggtgatgacctttcaggcagcggttccgctcaactaccattacgcgtaccgcctcgacaccggcgactccactctcacaaacgaaccctctgaacagtttgccaacaagttcatgcagatgacaccgttcacccgttggaggcttcgtctgtctgcgtccgcaaaagagaatgcaggattagcctttcccacagctacagctcccgactccaccactgagattgtcatcactttccatgttacggccatcagacaaattgactggcggcacgacgaagagtagc

SEQ ID NO: 477 - DNA, 2598 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaaggcaggagttggacgacgccatcgctaagatggaccgactgagcttgcagatggaggcagaggacagagcaatggagcaagccaaaaaggaaatggacgaaggattgaagcagttccagaataggcaagttgcgaacgccctctttgccgttcttagcgctgtagctcagattgggctcgcattcgtcacggctggtgcaacggctcctggagctgtggcgtcggcggggcaagctgtgagcatagcaggtcaggcggcgcaaggtctgcgaagggtggtggagattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccgacggaagtctcggaggttccggtgtggagggccaagtgcaagaatgtggctgcactgggtcgggagatgagcatcacggcagtacagatgtcggagctgcagtatgacatctgggtgcaaggcttgttgcgggatatagctcaaagccacgcagaccggctggcagcgattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggaatttgagattcctgtgcaaggtggcatgtccagcttcccttccagctggtctcgcgtccgtattcggcacctggagatgcactttgtgcaggaggcgagcggtggcggcgagattatccaccagcctgccacccagacggggaccattcacatcctcctgcagggctccactgtcttccatgaccgcagaagagaccaggtgttgccttttcaggccgctgctccgctcaactaccattacgcgtaccgcctcgacactggagaagccactcttacgaacgaaccctctgaacagtttgccaacaagttcatgcagatgacacccttcacccgttggaggcttcgtctgtctgcgtccgcaaaagagaatgcaggattagcctttcccacagctacagctcccgactccaccactgagattgccatcactttccatgttacggccattagacaaattgactggcggcaagaggaggag

SEQ ID NO: 478 - DNA, 2598 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgacagagaggtgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaagtcagattgtggatgcaccacctatgccagacatgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagaacagatttcccagctccagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaagacatacctgtgaacttgctgctcgatggcgaggattgggagtttgagattcctgtgcaagctggcatgtccagcttcccttccagctggactcgagtgcggattcggcacctggagatgcactttgtgcaggaggcgagcggtggcggcgagattatccaccagcctaccacccagactgggaccgtttacatccttctgcagggttccactatcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 479 - DNA, 2602 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacaaggcctttgctgacagagaggtgcagatggagagctttcattcagcggtcatttctcaaagaaggcaggagttggacgacgccatcgctaagatggaccgactgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattcgtcacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtagggagatgtgcatcacggcagtacagatgtcggagctgcagtatgacatctgggtgcaaggcttgttgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtagtgaaaggcatacctgtgagcttgcttctagacggtggggattgggaatttgagattcctgtgcaagctggcatgtccagtttcccttccagctggactcgagtgcggattcggcacctggagatgcactttgtgaaggaggcgagcggtggcggcgagattatccaccagcctgccacccagacggggaccatttacatccttctgcagggttccactatcttccatgaccgcagaagagaccaggtgttgccttttcaggccgctgctccgctcaactaccattacgcgtaccgcctcgacactggagaagccactcttacgaacgagccctctgaacagtttgccaacacattcatgcagatgacacccttcacccgttggaggcttcgtctgtctgcgtccgcagcggagaataaaggattagcctttcccacagctacagctcccgactccaccactgagattgccatcactttccatgttacggccatcagacaaattgactggcggcacgacgaagagtagc

SEQ ID NO: 480 - DNA, 2605 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcattctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggacgcaccggtgatgccggaattgccctcagaggcggactggtccatttttgtgaacgaggtggaggccgtggcagagggcatgccaacggaagtctcggaggttccggcgtggaaggccaagtgcaagaatgtggctgcactgggtagggagatgagcatcacggcagtacagatgtcggagctgcagtatgacatctgggtgcaaggcttgttgcgggatatggctcgaagccaggcagacaggctggccgcgattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcacgcacgagagtgctgcactgtcaggattagctcagttagggcccccatcggacttcacgagcaggcatgtggtgaaaggcatacctgtgagcttgctgctcgatggcgaggattgggagtttgagattcctgtgcaagctggcatgtccagtttcccttccagctggtctcgcgtccgtattcggcacctggagatgcactttgtgaaggaggccagcggtattggtggtgagattatccaccagcctaccacccagactgggaccgtttacatcctcctgcagggctccactgtcttccatgatcgcagaagggaggaggtgatgacctttcaggccgctgctccgctcaactaccattacgcgtaccgcctcgacactggagaagccactcttacgaacgagccctcggaacagtttgccaacacattcatgcagatgacacccttcacccgttggaggctacgtctgtctgcgtccgcaaaagagaatgcaggattagcctttcccacagctacagctcccgactccaccactgagattgccatcactttccatgttacggccatcagacaaattgactggcggcacgacgaagagtagc

SEQ ID NO: 481 - DNA, 2598 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacgacgccatcgctaagatggaccgactgagcttgcagatggaggaagaggacagagcaatggagcaagccaaaaaggaaatggacgaaggattgaggcagttccagaataggcaagttgcgaacgccctctttgccgttcttagcgctgtagctcagattgggctcgcattcgtcacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctgtgaaggacctcgtggattcattggaacaggtaggtcagattgtggacgcaccggtgatgccagacatgccctcggaggcggactggagtatttttgtgaacgaggtggaggccgtggcagaggggatgccgacggaagtctcggaggttccggtgtggagggccaagtgcaagaatgtggctgcactgggtagggagatgtgcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacataatgcgcatccagaatgcggcacttatgtatgagtaccttctaacgcccacgcagctcactgcatggccgctgagaatggatactgtggccaacttgctcatcacgcaggagaatgctgcactgataggattaatgcagctagggccctcatctgatttcacgagcaggcatgtggtgaaagacatacctgtgaacttgctgctcgatggcgaggattgggagtttgagattcctgtgcaaggtggcatgtccagcttcccttccagctggtctcgcgtccgtattcggcacctggagatgcactttgtgcaggaggcgagcggtggcggcgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcagcggagaataaaggattagcctttcccacagctacagctcccgactccaccactgagattgccatcactttccatgttacggccattagacaaattgactggcggcaagaggaggag

SEQ ID NO: 482 - DNA, 2598 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaaggcaggagttggacgacgccatcgctaagatggaccgactgagcttgcagatggaggaagaggacagagcaatggagcaagccaaaaaggaaatggacgaaggattgaggcagttccagaataggcaagttgcgaacgccctctttgccgttcttagcgctgtagctcagattgggcttgcatcccttacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtagggagatgtgcatcacggcagaacagatgtcggagctgcagtatgacatctgggtgcaaggcatgatgcgggatatggctcgaagccaggcagacaggctggccgcaattcaacccgcggaccttaccaactatttggagatggcaatacagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgcaggaggcgagcggtggcggcgagattatccaccagcctgccacccagacggggaccgtttacatccttctgcagggttccactatcttccatgatcgcagaagggaggaggtgatgacctttcaggcagcggttccgctcaactaccattacgcgtaccgcctcgacaccggcgactccactctcacaaacgaaccctctgaacagtttgccaacaagttcatgcagatgacaccgttcactcgctggaggctacgtctgtctgcgtccgcaaaagagaatgcaggattagcctttcccacagctacagctcccgactccaccactgagattgccatcactttccatgttacggccattagacaaattgactggcggcacgacgaggag

SEQ ID NO: 483 - DNA, 2598 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaaggcaggagttggacgacgccatcgctaagatggaccgactgagcttgcagatggaggaagaggacagagcaatggagcaagcccgaaaagaaatggaagaaggattgaggcagttccagaatgagcaagttgcaagggctgtgttcgctgttcttaaatctgtagctatgattgcgctcgcattcgtcacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagaggggatgccgacggaagtctcggaggttccggcgtggagggccaagtgcaagaatgtggctgcactgggtcgggagatgtgcatcacggcagtacagatgtcggagctgcagtatgacatctgggtgcaaggcatgatgcgggatatggctcgaagccaggcagacaggctggccgcaattcaacccgcggaccttaccaactatttggagatggcaatacagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacaccgttcactcactggaggctacgtctgtctgcgtccgcaaaagagaatgcaggattagcctttcccacggctacagcacttgactccactacccagattgtcatcactttccatgttacggccatcagacaaattgactggcggcaagaggaggag

SEQ ID NO: 484 - DNA, 2605 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaaggcaggagttggacaatacattcgcaaagatggaccgattgagcgggcaaatggaggaagaggacagagcaatggagcaagcccgaaaagaaatggaagaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggtccatttttgtgaatgagattgaagccgtggcagaggggatgccgacggaagtctcggaggttccggcgtggaaggccaagtgcaagaatgtggctgcactgggtagggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacataatgcgcatccagaatgcggcacttatgtatgagtaccttctaacgcccacgcagctcactgcatggccactgggtatggataccgtgggtgacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggtctcgcgtccgtattcggcacctggagatgcactttgtgaaggaggccagcggtattggtggtgagattatccaccagcctgccacccagacggggaccatttacatcctcctgcagggctccactgtcttccatgatcgcagaagagaccaggtgttgccttttcaggccgctgctccgctcaactaccattacgcgtaccgcctcgacactggagaagccactcttacgaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcaagaggaggagtagc

SEQ ID NO: 485 - DNA, 2602 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcattcagcggtcatttctcaaagaaggcaggagttggacgacgccatcgctaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcactccttacggctggtgcaacggctcctggagctgtggcgtcggcggggcaagctgtgagcatagcaggtcaggcggcgcaaggtctgcgaagggtggtggaaactctagagcagctggaggctgtgatggaggttgtggctgctgtgaaggacctcgtggattcattggaacaggtaggtcagattgtggatgcaccacctatgccagacatgccctcggaggcggactggtccatttttgtgaatgagattgaagccgtggcagaggggatgccgacggaagtctcggaggttccggcgtggaaggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaaggcatacctgtgagcttgcttctagacggtggggattgggaatttgagattcctgtgcaaggtggcatgtccagcttcccttccagctggtctcgcgtccgtattcggcacctggagatgcactttgtgcaggaggcgagcggtggcggcgagattatccaccagcctaccacccagactgggaccgtttacatccttctgcagggttccactatcttccatgaccgcagaagggaggaggtgatgacctttcaggcagcggttccgctcaactaccattacgcgtaccgcctcgacactggagaagccactcttacgaacgagccctcggaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagagtagc

SEQ ID NO: 486 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcattctgctgtcatttctcaaagaaggcaggagttggacgacgccatcgctaagatggaccgactgagcttgcagatggaggaagaggacagagcaatggagcaagcccgaaaagaaatggaagaaggattgaggcagttccagaataggcaagttgcgaacgccctctttgccgttcttaaatctgtagctatgattgcgctcgcattcgtcacggctggtgcaacggctcctggggctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccagacatgccctcggaggcggactggagtatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggcagcgattcaacctgctaatcttaccaactatttggagatggctacccagatggatatgcggactacgaggatgctgctggggctcctcaacataatgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtagtgaaaggcatacctgtgagcttgcttctagacggtggggattgggagtttgagattcctgtgcaaggtggcatgtccagcttcccttccagctggtctcgcgtccgtattcggcacctggagatgcactttgtgcaggaggccagcggtattggtggtgagattatccaccagcctgccacccagacggggaccatttacatcctcctgcagggctccactgtcttccatgatcgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggctacgtctgtctgcgtccgcaaaagagaatgcaggattagcctttcccacggctacagcacttgactccaccactgagattgccatcactttccatgttacggccatcagacaaattgactggcggcaagaggaggag

SEQ ID NO: 487 - DNA, 2598 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggggctgcagcatctgcagcgcaagctgtgaacatagccggtcaggcggcgcaaggtctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggagtatttttgtgaacgaggtggaggccgtggcagaggggatgccgacggaagtctcggaggttccggcgtggaaggccaagtgcaagaatgtggctgcactgggtcgggagatgagcatcacggcagaacagatttcccagctccagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattagctcagttagggcccccatcggacttcacgagcaggcatgtagtgaaaggcatacctgtgagcttgcttctagacggtggggattgggaatttgagattcctgtgcaagctggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggccgctgctccgctcaactaccattacgcgtaccgcctcgacaccggcgactccactctcacaaacgaaccctctgaacagtttgccaacacattcatgcagatgacaccgttcactcactggaggctacgtctgtctgcgtccgcaaaagagaatgcaggattagcctttcccacggctacagcacttgactccaccactgagattgccatcactttccatgttacggccatcagacaaattgactggcggcaagaggaggag

SEQ ID NO: 488 - DNA, 2605 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcattctgctgtcatttctcaaagaagggaggagttggacaatacattcgcaaagatggaccgactgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccagacatgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcttgttgcgggatatagctcaaagccacgcagaccggctggcagcgattcaacctgctaatcttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggccagcggtattggcggtgagattatccaccagcctaccacccagactgggaccgtttacatccttctgcagggttccactaccttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcagcggagaataaaggattagcctttcccacagctacagctcccgactccaccactgagattgccatcactttccatgttacggccatcagacaaattgactggcggcacgacgaagagtagc

SEQ ID NO: 489 - DNA, 2605 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctgtgaaggacctcgtggattcattggaacaggtaggtcagattgtggatgcaccacctatgccagacatgccctcggaggcggactggtccatttttgtgaacgaggtggaggccgtggcagagggcatgccaacggaagtctcggaggttccggcgtggaaggccaagtgcaagaatgtggctgcactgggtagggagatgtgcatcacggcagaacagatttcccagctccagtatgacatctgggtgcaaggcatgatgcgggatatggctcgaagccaggcagacaggctggccgcaattcaacccgcggaccttaccaactatttggagatggcaatacagatggatatgcggactacgaggatgctgctggggctcctcaacatattgcgcatccagaatgcggcgctcaggtacgagtatcttctaatgcccacggagctcacaacatggccgctgagaatggatactgtggccaacttgctcatcacgcacgagagtgctgcactgtcaggattagctcagttagggcccccatcggacttcacgagcaggcatgtggtgaaagacatacctgtgaacttgctgctcgatggcgaggattgggagtttgagattcctgtgcaaggtggcatgtccagtttcccttccagctggtctcgcgtccgtattcggcacctggagatgcactttgtgaaggaggccagcggtattggtggcgagattatccaccagcctgccacccagactgggaccgtttacatccttctgcagggctccactgtcttccatgaccgcagaagggaggaggtgatgacctttcaggcagcggttccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaggagaatgcaggattagcctttcccacagctacagctcccgactccaccactgagattgccatcactttccatgttacggccattagacaaattgactggcggcacgacgaagagtagc

SEQ ID NO: 490 - DNA, 2602 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacgacgccatcgctaagatggaccgactgagcttgcagatggaggaagaggacagagcaatggagcaagccaaaaaggaaatggacgaaggattgaggcagttccagaataggcaagttgcgaacgccctctttgccgttcttagcgctgtagctcagattgggctcgcattcgtcacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgtgcatcacggcagaacagatttcccagctccagtatgacatctgggtgcaaggcatgatgcgggatacagctcaaagccacgcagaccggctggcagcgattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcacgagagtgctgcactgtcaggattagctcagttagggcccccatcggacttcacgagcaggcatgtggtgaaagacatacctgtgagcttgctgctcgatggcgaggattgggagtttgagattcctgtgcaagctggcatgtccagcttcccttccagctggtctcgcgtccgtattcggcacctggagatgcactttgtgaaggaggccagcggtggcggcgagattatccaccagcctaccacccagactgggaccgtttacatccttctgcagggctccactgtcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcgaaagagaatgcaggattagcctttcccacagctacagctcccgactccaccactgagattgccatcactttccatgttacggccatcagacaaattgactggcggcacgacgaagagtagc

SEQ ID NO: 491 - DNA, 2598 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggtccatttttgtgaatgagattgaagccgtggcagaggggatgccgacggaagtctcggaggttccggtgtggagggccaagtgcaagaatgtggctgcactgggtagggagatgtgcatcacggcagaacagatttcccagctccagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcacgagagtgctgcactgtcaggattagctcagttagggcccccatcggacttcacgagcaggcatgtagtgaaaggcatacctgtgagcttgctgctcgatggcgaggattgggagtttgagattcctgtgcaaggtggcatgtccagtttcccttccagctggactcgagtgcggattcggcacctggagatgcactttgtgcaggaggcgagcggtggcggcgagattatccaccagcctaccacccagacggggaccatttacatcctcctgcagggctccactgtcttccatgatcgcagaagagaccaggtgttgccttttcaggccgctgctccgctcaactaccattacgcgtaccgcctcgacactggagaagccactctcacaaacgaaccctctgaacagtttgccaacaagttcatgcagacgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 492 - DNA, 2598 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacaaggcctttgctgacagagaggtgcagatggagagctttcatgctgctgtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtagggagatgtgcatcacggcagaacagatttcccagctccagtatgacatctgggtgcaaggcttgttgcgggatatagctcgaagccaggcagacaggctggccgcaattcaacccgcggaccttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggtctcgcgtccgtattcggcacctggagatgcactttgtgcaggaggcgagcggtggcggcgagattatccaccagcctgccacccagacggggaccatttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcagcggagaataaaggattagcctttcccacagctacagctcccgactccaccactgagattgccatcactttccatgttacggccattagacaaattgactggcggcaagaggaggag

SEQ ID NO: 493 - DNA, 2602 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcattcagcggtcatttctcaaagaaggcaggagttggacgacgccatcgctaagatggaccgactgagcttgcagatggaggcagagagtagtgcaatggagcaagccaaaaaggaaatggacgaaggattgaggcagttccagaataggcaagttgcaagggctgtgttcgctgttcttaaatctgtagctatgattgcgctcgcattcgtcacggctggtgcaacggctcctggagctgtggcgtcggcggggcaagctgtgagcatagcaggtcaggcggcacaagctctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggcgtggaaggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtagtgaaaggcatacctgtgagcttgcttctagacggtggggattgggaatttgagattcctgtgcaaggtggcatgtccagtttcccttccagctggtctcgcgtccgtattcggcacctggagatgcactttgtgcaggaggcgagcggtggcggcgagattatccaccagcctgccacccagacggggaccatttacatccttctgcagggttccactatcttccatgaccgcagaagagaccaggtgttgccttttcaggccgctgctccgctcaactaccattacgcgtaccgcctcgacactggagaagccactcttacgaacgagccctcggaacagtttgccaacacattcatgcagatgacaccgttcactcactggaggcttcgtctgtctgcgtccgcaaaagagaatgcaggattagcctttcccacggctacagcacttgactccactacccagattgtcatcactttccatgttacggccgttagacaaattgactggcggcacgacgaagagtagc

SEQ ID NO: 494 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgacagagaggtgcagatggagagctttcattcagcggtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgtcatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagcttcccttccagctggtctcgcgtccgtattcggcacctggagatgcactttgtgaaggaggcgagcggtattggtggtgagattatccaccagcctgccacccagactgggaccatttacatcctcctgcagggctccactgtcttccatgatcgcagaagagaccaggtgttgccttttcaggccgctgctccgctcaactaccattacgcgtaccgcctcgacaccggcgactccactctcacaaacgaaccctctgaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccatcagacaaattgactggcggcaagaggaggag

SEQ ID NO: 495 - DNA, 2602 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgagcatagcaggtcaggcggcgcaaggtctgcgaagggtggtggaaattctagaggggctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtagggagatgtgcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtagtgaaaggcatacctgtgagcttgcttctagacggtggggattgggaatttgagattcctgtgcaaggtggcatgtccagtttcccttccagctggtctcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactctcacaaacgaaccctctgaacagtttgccaacacattcatgcagatgacaccgttcactcactggaggctacgtctgtctgcgtccgcaaaagagaatgcaggattagcctttcccacagctacagctcccgactccaccactgagattgccatcactttccatgttacggccattagacaaattgactggcggcacgacgaagagtagc

SEQ ID NO: 496 - DNA, 2598 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcattcagcggtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggtccatttttgtgaacgaggtggaggccgtggcagagggcatgccaacggaagtctcggaggttccggcgtggaaggccaagtgcaagaatgtggctgcactgggtcgggagatgtgcatcacggcagaacagatttcccagctccagtatgacatctgggtgcaaggcttgttgcgggatatagctcaaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtggtgaaagacatacctgtgaacttgctgctcgatggcgaggattgggagtttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggttccactatcttccatgaccgcagaagggaggaggtgatgacctttcaggcagcggttccgctcaactaccattacgcgtaccgcctcgacaccggcgactccactctcacaaacgaaccctctgaacagtttgccaacacattcatgcagatgacacccttcacccgttggaggcttcgtctgtctgcgtccgcaaaagagaatgcaggattagcctttcccacagctacagctcccgactccaccactgagattgccatcactttccatgttacggccatcagacaaattgactggcggcaagaggaggag

SEQ ID NO: 497 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggaagaggacagagcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggtgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggcgtggaaggccaagtgcaagaatgtggctgcactgggtagggagatgtgcatcacggcagaacagatttcccagctccagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacataatgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacactggagaagccactcttacgaacgagccctcggaacagtttgccaacacattcatgcagatgacacccttcacccgttggaggcttcgtctgtctgcggccgcaaaagagaatgcaggattagcctttcccacggctacagcacttgactccactacccagattgtcatcactttccatgttacggccattagacaaattgactggcggcacgaggaggag

SEQ ID NO: 498 - DNA, 2598 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggggctgtggcgtcggcggggcaagctgtgagcatagcaggtcaggcggcgcaaggtctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggagtatttttgtgaatgagattgaagccgtggcagaggggatgccgacggaagtctcggaggttccggcgtggagggccaagtgcaagaatgtggctgcactgggtagggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggcaatacagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattagctcagttagggcccccatcggacttcacgagcaggcatgtagtgaaaggcatacctgtgagcttgcttctagacggtggggattgggaatttgagattcctgtgcaaggtggcatgtccagcttcccttccagctggtctcgcgtccgtattcggcacctggagatgcactttgtgcaggaggcgagcggtggcggcgagattatccaccagcctgccacccagacggggaccatttacatcctcctgcagggctccactgtcttccatgatcgcagaagagaccaggtgttgccttttcaggccgctgctccgctcaactaccattacgcgtaccgcctcgacactggagaagccactcttacgaacgagccctcggaacagtttgccaacaagttcatgcagatgacacccttcactcactggaggctacgtctgtctgcgtccgcagcggagaataaaggattagcctttcccacagctacagctcccgactccaccactgagattgtcatcactttccatgttacggccattagacaaattgactggcggcaagaggaggag

SEQ ID NO: 499 - DNA, 2598 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggggctgtggcgtcggcggggcaagctgtgagcatagcaggtcaggcggcgcaaggtctgcgaagggtggtggaaattctagaggggctcgaggctgtgatggaggttgtggctgctataaagcaccttgtggatgctctggaacaggtaggtcagattgtggatgcaccacctatgccagacatgccctcggaggcggactggtccatttttgtgaacgaggtggaggccgtggcagaggggatgccgacggaagtctcggaggttccggcgtggaaggccaagtgcaagaatgtggctgcactgggtcgggagatgagcatcacggcagtacagatgtcggagctgcagtatgacatctgggtgcaaggcttgttgcgggatatagctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcacgcacgagagtgctgcactgtcaggattagctcagttagggcccccatctgatttcacgagcaggcatgtggtgaaaggcatacctgtgagcttgcttctagacggtggggattgggaatttgagattcctgtgcaaggtggcatgtccagcttcccttccagctggactcgcgtccgtattcggcacctggagatgcactttgtgcaggaggcgagcggtggcggcgagattatccaccagcctaccacccagactgggaccgtttacatccttctgcagggttccactgtcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagctcccgactccactacccagattgtcatcactttccatgttacggccattagacaaattgactggcggcaagaggaggag

SEQ ID NO: 500 - DNA, 2598 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctcagattgggctcgcattcgtcacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccgacggaagtctcggaggttccggcgtggaaggccaagtgcaagaatgtggctgcactgggtcgggagatgagcatcacggcagaacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacataatgcgcatccagaatgcggcgctcaggtacgagtatcttctaatgcccacggagctcacaacatggccactgggtatggataccgtgggtgacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagcttcccttccagctggtctcgcgtccgtattcggcacctggagatgcactttgtgaaggaggccagcggtggcggcgagattatccaccagcctgccacccagacggggaccatttacatcctcctgcagggttccactatcttccatgaccgcagaagggaggaggtgatgacctttcaggcagcggttccgctcaactaccattacgcgtaccgcctcgacaccggcgactccactctcacaaacgaaccctctgaacagtttgccaacacattcatgcagatgacacccttcacccgttggaggcttcgtctgtctgcgtccgcagcggagaataaaggattagcctttcccacagctacagctcccgactccaccactgagattgtcatcactttccatgttacggccatcagacaaattgactggcggcaagaggaggag

SEQ ID NO: 501 - DNA, 2602 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcagacaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaaggcaggagttggacgacgccatcgctaagatggaccgactgagcttgcagatggaggaagaggacagagcaatggagcaagcccgaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaatgagattgaagccgtggcagaggggatgccaacggaagtctcggaggttccggtgtggagggccaagtgcaagaatgtggctgcactgggtcgggagatgtgcatcacggcagtacagatgtcggagctgcagtatgacatctgggtgcaaggcttgttgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagagtagc

SEQ ID NO: 502 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccgactttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggaggtgcagatggagagctttcattcagcggtcatttctcaaagaaggcaggagttggacaatacattcgcaaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggagctgtggcgtcggcggggcaagctgtgagcatagcaggtcaggcggcacaagctctgcgaagggtggtggaaattctagaggggctcgaggctgtgatggaggttgtggctgctgtgaaggacctcgtggattcattggaacaggtaggtcagattgtggacgcaccggtgatgccggaattgccctcggaggcggactggtccatttttgtgaacgaggtggaggccgtggcagaggggatgccgacggaagtctcggaggtcccggcgtggaaggccaagtgcaagaatgtggctgcactgggtagggagatgtgcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatactgatagggctcctcaacatattgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtggtgaaagacatacctgtgaacttgctgctcgatggcgaggattgggagtttgagattcctgtgcaagctggcatgtccagcttcccttccagctggactcgagtgcggattcggcacctggagatgcactttgtgaaggaggccagcggtattggtggtgagattatccaccagcctgccacccagactgggaccgtttacatccttctgcagggttccactatcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacggctacagcacttgactccactacccagattgtcatcactttccatgttacggccattagacaaattgactggcggcacgacgaagag

SEQ ID NO: 503 - DNA, 2598 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcagatggaggaagaggacagagcaatggagcaagcccgaaaagaaatggaagaaggattgaagcagttccagaatgagcaagttgcaagggctgtgttcgctgttcttaaatctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggaaggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggcaatacagatggatatgcggactacgaggatgctgctggggctcctcaacatattgcgcatccagaatgcggcgctcaggtacgagtatcttctaatgcccacggagctcacaacatggccactgggtatggataccgtggccaacttgctcatcacgcacgagagtgctgcactgtcaggattagctcagttagggccctcatctgatttctcgagcaggcatgtagtgaaaggcatacctgtgagcttgcttctagacggtggggattgggagtttgagattcctgtgcaagctggcatgtccagcttcccttccagctggtctcgcgtccgtattcggcacctggagatgcactttgtgaaggaggcgagcggtggcggcgagattatccaccagcctaccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccattagacaaattgactggcggcaagaggaggag

SEQ ID NO: 504 - DNA, 2602 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacaaggcctttgctgacagagaggtgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaatgagcaagttgcaagggctgtgttcgctgttcttaaatctgtagctatgattgcgctcgcattcgtcacggctggtgcaacggctcctggagctgtggcgtcggcggggcaagctgtgagcatagcaggtcaggcggcacaaggtctgcgaagggtggtggaaattctagaggggctcgaggctgtgatggaggttgtggctgctgtgaaggacctcgtggattcattggaacaggtaggtcagattgtggatgcaccggtgatgccggaattgccctcagaggcggactggtccatttttgtgaacgaggtggaggccgtggcagagggcatgccgacggaagtctcggaggttccggcgtggagggccaagtgcaagaatgtggctgcactgggtagggagatgtgcatcacggcagtacagatttcccagctccagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggcccccatcggacttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgcaggaggcgagcggtggcggcgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccatcagacaaattgactggcggcacgacgaagagtagc

SEQ ID NO: 505 - DNA, 2050 bp, Artificial Sequence
  PtIP-83 polypeptide variant encoding polynucleotide
atggattacagcacgctttacagggatctgaaccagataagcatgcccctggatcgggtagagttctcagaggtgatggtgatccacaggatgtatgtgaggctagctgatctgaatgtgggggagctccccggagccgagagggtgaagcggttgtatgtgttggcagacgtggtgactgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggagtatttttgtgaacgaggtggaggccgtggcagagggcatgccaacggaagtctcggaggttccggtgtggagggccaagtgcaagaatgtggctgcactgggtagggagatgtgcatcacggcagtacagatgtcggagctgcagtatgacatctgggtgcaaggcatgatgcgggatatagctcaaagccacgcagaccggctggcagcgattcaacctgctaatcttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtagtgaaaggcatacctgtgagcttgcttctagacggtggggattgggaatttgagattcctgtgcaaggtggcatgtccagtttcccttccagctggtctcgcgtccgtattcggcacctggagatgcactttgtgaaggaggccagcggtattggtggtgagattatccaccagcctaccacccagactgggaccgtttacatccttctgcagggctccactgtcttccatgatcgcagaagggaggaggtgatgacctttcaggcagcggttccgctcaactaccattacgcgtaccgcctcgacaccggcgactccactctcacgaacgagccctcggaacagtttgccaacacattcatgcagatgacacccttcacccgttggaggcttcgtctgtctgcgtccgcagcggagaataaaggattagcctttcccacagctacagctcccgactccaccactgagattgccatcactttccatgttacggccattagacaaattgactggcggcacgacgaagagtagc

SEQ ID NO: 506 - DNA, 2569 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcagacaacggtacacattgcggagctagtcaaggcatgtcatccgtcacccgatgttgtgagcgctgtaggggagcacctgaactggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcaaccaaatggcccaggtagcacagaactacgaccaagatttcaggcagctcaagttattcattgcccaaaaccaaatccttggcagctatttgctgcagcagaacagggcatttgctgacagagaggtgcagatggagagctttcattcagcggtcatttctcaaagaaggcaggagttggacgacgccatcgctaagatggaccgactgagcttgcagatggaggaagaggacagagcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggaaggccaagtgcaagaatgtggctgcactgggtcgggagatgagcatcacggcagaacagatgtcggagctgcagtatgacatctgggtgcaaggcttgatgcgggatatggctcgaagccaggcagacaggctggccgcaattcaacccgcggaccttaccaactatttggagatggctacccagatggatatgcggactacgaggatgctgctggggctcctcaacataatgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggcccccatcggacttcacgagcaggcatgtagtgaaaggcatacctgtgagcttgcttctagacggtggggattgggaatttgagattcctgtgcaagctggcatgtccagtttcccttccagctggactcgagtgcggattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacactggagaagccactcttacgaacgagccctcggaacagtttgccaacacattcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagagtagc

SEQ ID NO: 507 - DNA, 2563 bp, Artificial Sequence
  PtIP-83 polypeptide variant encoding polynucleotide
atggattacagcacgctttacagggatctgaaccagataagcatgcccctggatcgggtagagttctcagaggtgatggtgatccacaggatgtatgtgaggctagctgatctgaatgtggggcagctcgagggagccgagaaagtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcataggacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcacccgatgttgtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcatgctgctgtcatttctcaaagaaggcaggagttggacgacgccatcgctaagatggaccgactgagcttgcagatggaggaagaggacagagcaatggagcaagccaaaaaggaaatggacgaaggattgaggcagttccagaataggcaagttgcgaacgccctctttgccgttcttagcgctgtagctcagattgggctcgcattccttacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggccagcggtattggtggtgagattatccaccagcctaccacccagacggggaccatttacatcctcctgcagggctccactgtcttccatgatcgcagaagggaggaggtgatgacctttcaggcagcggttccgctcaactaccattacgcgtaccgcctcgacaccggcgactccactctcacaaacgagccctcggaacagtttgccaacacattcatgcaggtgacacccttcacccgttggaggcttcgtctgtctgcgtccgcaaaagagaatgcaggattagcctttcccacggctacagcacttgactccactacccagattgtcatcacttttcatgttacggccatcagacaaattgactggcggcacgacgaagagtagc

SEQ ID NO: 508 - DNA, 2569 bp, Artificial Sequence
  PtIP-83 polypeptide variant encoding polynucleotide
atggctctcgtggattacggcaagcttttcgaggatctgaaccagataagcatgcccctggatcgggtagagttctcagaggtgatggtgatccacaggatgtatgtgaggctagctgatctgaatgtggggcagctcgagggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtcaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtacggtagcctcatcaaccaaatggcccaggtagcacagaactacgaccaagatttcaggcagctcaagttattcattgcccaaaaccaaatccttggcagctatttgctgcagcagaacagggcatttgctgagagggagctgcagatggagagctttcatgctgctgtcatttctcaaagaagggaggagttggacaatacattcgcaaagatggaccgactgagcttgcagatggaggaagaggacagagcaatggagcaagccaaaagggaaatggacgaaggattgaggcagttccagaatgagcaagttgcaagggctgtgttcgctgttcttaaatctgtagctatgattgcgctcgcattcgtcacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctataaagcaccttgtggatgctctggaccaggtaagtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtagggagatgtgcatcacggcagaacagatttcccagctccagtatgacatctgggtgcaaggcttgttgcgggatatagctcaaagccacgcagaccggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcacgcacgagagtgctgcactgtcaggattagctcagttagggcccccatcggacttcacgagcaggcatgtggtgaaagacatacctgtgaacttgctgctcgatggcgaggattgggagtttgagattcctgtgcaagctggcatgtccagtttcccttccagctggactcgagtgcggattcggcacctggagatgcactttgtgcaggaggcgagcggtggcggcgagattatccaccagcctaccacccagactgggaccgtttacatccttctgcagggttccactgtcttccatgatcgcagaagggaggaggtgatgacctttcaggcagcggttccgctcaactaccattacgcgtaccgcctcgacaccggcgactccactctcacgaacgagccctcggaacagtttgccaacaagttcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcacgacgaagagtagc

SEQ ID NO: 509 - DNA, 2565 bp, Artificial Sequence
  PtIP-83 polypeptide variant encoding polynucleotide
atggctctcgtggattacggcaagcttttcgaggatctgaaccagataagcatgcccctggatcgggtagagttctcagaggagatggtgatccacaggatgtatgtgaggctagctgatctgaatgtggggcagctcgagggagccgagaaagtgaagcggttgtatgtgttggcagacgtggtggagctcgccacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccccagctgcaatacagaatgtacggtagcctcatcagacaaatggcccaggtagcacagaactacgaccgagaattcaagcaattcaaattattcatcatccaaaatcaaatccttggcagctatttgctgcagcagaacagggcatttgctgagagggagctgcagatggagagctttcattcagcggtcatttctcaaagaaggcaggagttggacgacgccatcgctaagatggaccgactgagcttgcagatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcggaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaaccagctaatcttaccaactatttggagatggctatacagatggatatgcggactacgaggatgctgccggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaaggcatacctgtgagcttgcttctagacggtggggattgggaatttgagattcctgtgcaagctggcatgtccagcttcccttccagctggtctcgcgtccgtattcggcacctggagatgcactttgtgcaggaggcgagcggtggcggcgagattatccaccagcctgccacccagacggggaccatttacatcctcctgcagggctccactgtcttccatgatcgcagaagagaccaggtgttgccttttcaggccgctgctccgcccaactaccattacgcgtaccgcctcgacaccggcgactccactctcacaaacgaaccctctgaacagtttgccaacacattcatgcagatgacaccgttcactcactggaggctacgtctgtctgcgtccgcagcggagaataaaggattagcctttcccacagctacagctcttgactccaccactgagattgccatcactttccatgttacggccatcagacaaattgactggcggcacgacgaggag

SEQ ID NO: 510 - DNA, 2568 bp, Artificial Sequence
  PtIP-83 polypeptide variant encoding polynucleotide
atggctctcgtggattacggcaagcttttcgaggatctgaaccagataagcatgggtgtactggatcgggtagagtcctcagaggtgatggtaatccacaggatgtatgtgaggctagctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgctttcaatgtgtcatgaagatggggccgtttgtctcggtagtgccgcagctgcaatacagaatgtacggtagcctcatcaaccaaatggcccaagtagcacaaaactacgaccaagatttcaggcagctcaagttattcattgcccaaaaccaaatccttggcagctatttgctgcagcagaacagggcatttgctgagagggagctgcagatggagagctttcatgctgctgtcatttctcaaagaaggcaggagttggacgacgccatcgctaagatggaccgactgagcttgcagatggaggcagagagtagtgcaatggagcaagccaaaaaggaaatggacgaaggattgaggcagttccagaataggcaagttgcgaacgccctctttgccgttcttagcgctgtagctcagattgcgctcgcattcgtcacggctggtgcaacggctcctggagctgtggcgtcggcggggcaagctgtgagcatagcaggtcaggcggcgcaaggtctgcgaagggtggtggaaattctggaggggctcgaggctgtgatggaggttgtggctgctataaagcaccttgtggatgctctggaccaggtaagtcagattgtggatgcaccacctatgccagacatgccctcggaggcggactggtccatttttgtgaatgagattgaagccgtggcagagggcatgccaacggaagtctcggaggttccggtgtggagggccaagtgcaagaacgtggctgcactgggcagggagatgtgcatcacggcagtacagatgtcggagctgcagtatgacatctgggtgcaaggcatgatgcgggatatggctcgaagccaggcagacaggctggccgcaattcaacccgcggaccttaccaactatttggagatggcaatacagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatccttctgcagggttccactgtcttccatgatcgcagaagggaggaggtgatgacctttcaggcagcggttccgctcaactaccattacgcgtaccgcctcgacactggagaagccactcttacggacgagccctcggaacagtttgccaacaagttcatgcagatgacacccttcacccgttggaggcttcgtctgtctgcgtccgcagcggagaataaaggattagcctttcccacagctacagctcccgactccaccactgagattgccatcactttccatgttacggccattagacaaattgactggcggcaagaggaggag

SEQ ID NO: 511 - DNA, 2559 bp, Artificial Sequence
  PtIP-83 polypeptide variant encoding polynucleotide
atggattacagcacgctttacagggatctgaaccagataagcatgcccctggatcgggtagagttctcagaggtgatggagatccacaggatgtatgtgaggctagctgatctgaatgtggggcagctcgagggagccgagagggtgaagcggttgtatgtgtttgcggacgtggtggagctcgcaacatttgcgcatccacagttgcttaatacgcggatgccaggatcggcgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgctgggcatgcagacaacggtacacattgcggagctagtcaaggcatgtcatccgtcacccgatgttgtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcatgctgctgtcatttctcaaagaagggaggagttggacaatacattcgcaaagatggaccgattgagcgggcagatggaggaagaggacagagcaatggagcaagcccgaaaagaaatggaagaaggattgaggcagttccagaataggcaagttgcgaacgccctctttgccgttcttagcgctgtagctcagattgggcttgcattccttacggctggtgcaacggctcctggggctgtggcgtcggcggggcaagctgtgagcatagcaggtcaggcggcgcaaggtctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggtgtggagggccaagtgcaagaatgtggctgcactgggtcgggagatgagcatcacggcagtacagatgtcggagctccagtatgacatctgggtgcaaggcttgttgcgggatatagctcaaagccacgcagaccggctggcagcgattcaaccagctaatcttaccaactatttggagatggctacccagatggatatgcggactacgaggatgctgctggggctcctcaacataatgcgcatccagaatgcggcgctcatgtacgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaagctggcatgtccagcttcccttccagctggtctcgcgtccgtattcggcacctggagatgcactttgtgaaggaggccagcggtattggtggtgagattatccaccagcctgccacccagacggggaccatttacatcctcctgcagggctccactgtcttccatgatcgcagaagagaccaggtgttgccttttcaggccgctgctccgctcaactaccattacgcgtaccgcctcgacactggagaagccactcttacgaacgagccctcggaacagtttgccaacaagttcatgcagatgacaccgttcacccgttggaggcttcgtctgtctgcgtccgcagcggagaatgaaggattagcctttcccacagctacagctcccgactccaccactgagattgccatcactttccatgttacggccatcagacaaattgactggcggcaagaggaggag

SEQ ID NO: 512 - DNA, 2565 bp, Artificial Sequence
  PtIP-83 polypeptide variant encoding polynucleotide
atggctctcgtggattacggcaagcttttcgaggatctgaaccagataagcatgcccctggatcgggtagagttttcagaggtgatggtgatccacaggatgtatgtgaggctagctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcacccgatgttgtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacagggcatttgctgacagagaggtgcagatggagagctttcatgctgctgtcatttctcaaagaagggaggagttggacaatacattcgcaaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggtgtggaaggccaagtgcaagaatgtggctgcactgggtagggagatgtgcatcacggcagaacagatttcccagctccagtatgacatctgggtgcaaggcatgatgcgggatatggctcgaagccaggcagacaggctggccgcaattcaacccgcggaccttaccaactatttggagatggctacccagatggatatgcggactacgaggatactgatagggctcctcaacataatgcgcatccagaatgcggcgctcaggtacgagtatcttctaatgcccacggagctcacaacatggccactgggtatggataccgtgggtgacttgctcatcgcgcaggagaatgctgcactgtcaggattagctcagttagggcccccatcggacttcacgagcaggcatgtggtgaaagacatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatccttctgcagggctccactgtcttccatgatcgcagaagggaggaggtgatgacctttcaggcagcggttccgctcaactaccattacgcgtaccgcctcgacaccggcgactccactctcacaaacgaaccctctgaacagtttgccaacacattcatgcagatgacaccgttcactcactggaggctacgtctgtctgcgtccgcaaaagagaatgcaggattagcctttcccacggctacagcacttgactccaccactgagattgtcatcactttccatgttacggccatcagacaaattgactggcggcacgaggaggag

SEQ ID NO: 513 - DNA, 2556 bp, Artificial Sequence
  PtIP-83 polypeptide variant encoding polynucleotide
atggattacagcacgctttacagggatctgaaccagataagcatgcccctggatcgggtagagttctcagaggtgatggtgatccacaggatgtatgtgaggctagctgatctgaatgtggggcagctcgagggagccgagaaagtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcagacaacggtacacattgcggagctagtcaaggcatgtcatccgtcacccgatgttgtgagcgctgtaggggtgcacctgaactggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacagggcatttgctgacagagaggtgcagatggagagctttcattcagcggtcatttctcaaagaagggaggagttggacaatacattcgcaaagatggaccgattgagcgggcaaatggaggcagagagtagtgcaatggagcaagccaaaaaggaaatggaagaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggaaagccaagtgcaagaatgtggctgcactgggtagggagatgtgcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtggtgaaagacatacctgtgaacttgcttctagacggtggggattgggaatttgagattcctgtgcaaggtggcatgtccagtttcccttccagctggactcgcgtccgtattcggcacctggagatgcactttgtgcaggaggcgagcggtggcggcgagattatccaccagcctgccacccagactgggaccgtttacatccttctgcagggttccactatcttccatgatcgcagaagggaggaggtgatgacctttcaggcagcggttccgctcaactaccattacgcgtaccgcctcgacaccggcgactccactctcacaaacgaaccctctgaacagtttgccaacaagttcatgcagatgacacccttcacccgttggaggctacgtctgtctgcgtccgcaaaagagaatgcaggattagcctttcccacggctacagcacttgactccaccactgagattgccatcactttccatgttacggccatcagacaaattgactggcggcaagaggaggag

SEQ ID NO: 514 - DNA, 2560 bp, Artificial Sequence
  PtIP-83 polypeptide variant encoding polynucleotide
atggattacagcacgctttacagggatctgaaccagataagcatgcccctggatcgggtagagttttcagaggtgatggtgatccacaggatgtatgtgaggctagctgatctgaatgtggggcagctcgagggagccgagaaagtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcagacaacggtacacattgcggagctagtcaaggcatgtcatccgtcacccgatgttgtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagaggggctcgaggctgtgatggaggttgtggctgctataaagcaccttgtggatgctctggaccaggtaagtcagattgtggatgcaccacctatgccagacatgccctcagaggcggactggtccatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatggctcgaagccaggcagacaggctggccgcaattcaacccgcggaccttaccaactatttggagatggctacccagatggatatgcggactacgaggatgctgctggggctcctcaacataatgcgcatccagaatgcggcgctcatgtatgagtatcttctaatgcccacgcagctcacaacatggccactgggtatggataccgtgggtgacttgctcatcgcgcaggagaatgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctaccacccagacggggaccatttacatcctcctgcagggctccactgtcttccatgaccgcagaagagaccaggtgttgccttttcaggccgctgctccgctcaactaccattacgcgtaccgcctcgacactggagaagccactctcacaaacgaaccctctgaacagtttgccaacaagttcatgcagatgacacccttcacccgttggaggcttcgtctgtctgcgtccgcaaaagagaatgcaggattagcctttcccacagctacagctcccgactccaccactgagattgccatcactttccatgttacggccattagacaaattgactggcggcaagaggaggagtagc

SEQ ID NO: 515 - DNA, 2556 bp, Artificial Sequence
  PtIP-83 polypeptide variant encoding polynucleotide
atggattacagcacgctttacagggatctgaaccagataagcatgcccctggatcgggtagagttttcagaggtgatggtgatccacaggatgtatgtgaggctagctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcttggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtcaaggcatgtcatccgtcacccgatgttgtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaagtagcacaaaactacgaccgagaattcaagcaattcaaattattcatcatccaaaatcaaatccttggcagctatttgctgcagcagaacagggcatttgctgacagagaggtgcagatggagagctttcattcagcggtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcacaagctctgcgaagggtggtggaaattctagaggggctcgaggctgtgatggaggttgtggctgctataaagcaccttgtggattcattggaacaggtaggtcagattgtggacgcaccggtgatgccggaattgccctcagaggcggactggtccatttttgtgaacgaggtggaggccgtggcagagggcatgccaacggaagtctcggaggttccggcgtggaaggccaagtgcaagaatgtggctgcactgggtcgggagatgtgcatcacggcagaacagatgtcggagctgcagtatgacatctgggtgcaaggcttgttgcgggatatggctcgaagccaggcagacaggctggccgcaattcaacccgcggaccttaccaactatttggagatggcaatacagatggatatgcggactacgaggatactgatagggctcctcaacatattgcgcatccagaatgcggcgctcaggtacgagtatcttctaacgcccacggagctcacaacatggccactgggtatggataccgtgggtgacttgctcatcacgcacgagagtgctgcactgtcaggattagctcagttagggcccccatcggacttcacgagcaggcatgtagtgaaaggcatacctgtgagcttgcttctagacggtggggattgggagtttgagattcctgtgcaaggtggcatgtccagtttcccttccagctggactcgagtgcggattcggcacctggagatgcactttgtgaaggaggcgagcggtggcggcgagattatccaccagcctaccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacaagttcatgcagatgacaccgttcacacactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 516 - DNA, 2568 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcacccgatgttgtgagcgctgtaggggagcacctgaactggctcaacgaagtcttgctccgagttgtccagaaggaatctcagttgcaagggaccgaggcctacaacgagtgccttgcgcttttaggtcgcattcaatgtgtcatgaagatggtgagaattggcttagtagtgccccagctgcaatacagaatgtatggtagcctcatcagacaaatggcccaggtagcacagaactacgaccaagatttcaggcagctcaagttattcattgcccaaaatcaaatccttggcagctatttgctgcagcagaacaaggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaatgagcaagttgcaagggctgtgttcgctgttcttaaatctgtagctatgattgcgctcgcattcgtcacggctggtgcaacggctcctggagctgtggcgtcggcggggcaagctgtgaacatagccggtcaagcggcacaagctctgcgaagggtggtggaaattctagaggggctcgaggctgtgatggaggttgtggctgctgtgaaggacctcgtggattcattggaacaggtaggtcagattgtggacgcaccggtgatgccggaattgccctcggaggcggactggagtatttttgtgaatgagattgaagccgtggcagaggggatgccggcggaagtctcggaggttccggcgtggaaggccaagtgcaagaatgtggctgcactgggtagggagatgtgcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtagtgaaaggcatacctgtgagcttgcttctagacggtggggattgggaatttgagattcctgtgcaaggtggcatgtccagcttcccttccagctggtctcgcgtccgtattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgctaacacattcatgcagatgacaccgttcactcactggaggctacgtctgtctgcgtccgcaaaagagaatgcaggattagcctttcccacggctacagcacttgactccactacccagattgtcatcactttccatgttacggccatcagacaaattgactggcggcaagaggaggag

SEQ ID NO: 517 - DNA, 2575 bp, Artificial Sequence
  PtIP-83 polypeptide variant encoding polynucleotide
atggctctcgtggattacggcaagcttttcgaggatctgaaccagataagcatgggtgtactggatcgggtagagttctcagaggtgatggtgatccacaggatgtatgtgaggctagctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtacggtagcctcatcagacaaatggcccaggtagcacagaactacgaccaagatttcaggcagctcaagttattcattgcccaaaaccaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaagggaaatggacgaaggattgaggcagttccagaataggcaagttgcgaacgccctctttgccgttcttagcgctgtagctcagattgggctcgcattcgtcacggctggtgcaacggctcctggagctgtggcgtcggcggggcaagctgtgagcatagccggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtggtgaaaggcatacctgtgagcttgcttctagacggtggggattgggaatttgagattcctgtgcaaggtggcatgtccagtttcccttccagctggactcgcgtccgtattcggcacctggagatgcactttgtgcaggaggccagcggtattggtggtgagattatccaccagcctaccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcacgacgaagagtagc

SEQ ID NO: 518 - protein, 852 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDALDQVSQIVDAPPMPDMPSEADWSIFVNEIEAVAEGMPTEVSEVPAWKAKCKNVAALGREMCITAEQISQLQYDIWVQGLLRDMARSQADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 519 - protein, 853 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVARAVFAVLKSVAMIALAFVTAGATAPGAAASAAQAVNIAGQAAQALRRVVEILEQLEAVMEVVAAIKHLVDALDQVSQIVDAPPMPDMPSEADWSIFVNEIEAVAEGMPTEVSEVPVWRAKCKNVAALGREMSITAVQMSELQYDIWVQGMMRDMARSQADRLAAIQPADLTNYLEMATQMDMRTTRMLLGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVKEASGIGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 520 - protein, 853 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVQIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAIKHLVDALDQVSQIVDAPPMPDMPSEADWSIFVNEIEAVAEGMPTEVSEVPAWKAKCKNVAALGREMSITAVQMSELQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVKEASGIGGEIIHQPTTQTGTVYILLQGSTIFHDRRRDQVLPFQAAAPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 521 - protein, 852 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQAGMSSFPSSWTRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 522 - protein, 851 aa, Artificial Sequence
  PtIP-83 polypeptide variant
MDYSTLYRDLNQISMPLDRVEFSEVMVIHRMYLRLSDLNVGELPGAERVKRLYVFADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHSAVISQRRQELDDAIAKMDRLSLQMEEEDRAMEQARKEMEEGLKQFQNEQVARAVFAVLKSVAMIALAFVTAGATAPGAVASAGQAVSIAGQAAQGLRRVVEILEGLEAVMEVVAAIKHLVDALDQVSQIVDAPPMPDMPSEADWSIFVNEIEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTIFHDRRRDQVLPFQAAAPLNYHYAYRLDTGDSTLTNEPSEQFANKFMQMTPFTRWRLRLSASAAENKGLAFPTATAPDSTTEIAITFHVTAIRQIDWRQEEE

SEQ ID NO: 523 - protein, 853 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACHPSPDVVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEQLEAVMEVVAAVKDLVDSLDQVGQIVDAPVMPELPSEADWSIFVNEVEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 524 - protein, 853 aa, Artificial Sequence
  PtIP-83 polypeptide variant
MDYSTLYRDLNQISMPLDRVEFSEVMVIHRMYLRLSDLNVGELPGAEKVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQAKKEMDEGLRQFQNRQVANALFAVLSAVAQIGLAFLTAGATAPGAVASAGQAVSIAGQAAQGLRRVVEILEQLEAVMEVVAAIKHLVDALDQVSQIVDAPPMPDMPSEADWSIFVNEIEAVAEGMPTEVSEVPAWKAKCKNVAALGREMCITAEQISQLQYDIWVQGLLRDIAQSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 525 - protein, 853 aa, Artificial Sequence
  PtIP-83 polypeptide variant
MDYSTLYRDLNQISMPLDRVEFSEVMVIHRMYVRLADLNVGELPGAEKVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEQLEAVMEVVAAVKDLVDSLEQVGQIVDAPVMPELPSEADWSIFVNEVEAVAEGMPTEVSEVPAWKAKCKNVAALGREMSITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVKEASGIGGEIIHQPTTQTGTIYILLQGSTVFHDRRREEVMTFQAAVPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 526 - protein, 852 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILLGMQTSVHIAELVKACYPSPELVSAVGVHVNWLNKLLLPLKESTQLQGSESYKECLALLGRVHAAMKMVRIGLVVPQLQYRMYGSLINQMAQVAQNYDREFKQLKLFIAQNQILGSYLLQQNRAFAERELQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAIKHLVDALDQVSQIVDAPPMPDMPSEADWSIFVNEIEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGIGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 527 - protein, 834 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAMFTACAADAAAQAVSIAGQAAQGLRRVVEILEQLEAVMEVVAAIKHLVDALDQVSQIVDAPVMPELPSEADWSIFVNEVEAVAEGMPTEVSEVPVWRAKCKNVAALGREMCITAEQISQLQYDIWVQGLLRDIAQSHADRLAAIQPANLTNYLEMAIQMDMRTTRILIGLLNIMRIQNAALMYEYLLTPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 528 - protein, 853 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEIEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 529 - protein, 853 aa, Artificial Sequence
  PtIP-83 polypeptide variant
MDYSTLYRDLNQISMPLDRVEFSEVMVIHRMYLRLSDLNVGELPGAEKVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMCITAEQISQLQYDIWVQGLLRDIAQSHADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAAENKGLAFPTATAPDSTTEIAITFHVTAIRQIDWRQEEE

SEQ ID NO: 530 - protein, 853 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGEHVNWLNEVLLRVVQKESQLQGTEAYNECLALLGRIQCVMKMGPFVSVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEGLEAVMEVVAAVKDLVDSLEQVGQIVDAPVMPELPSEADWSIFVNEVEAVAEGMPTEVSEVPVWRAKCKNVAALGREMCITAEQISQLQYDIWVQGLLRDIAQSHADRLAAIQPANLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 531 - protein, 853 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAVKDLVDSLEQVGQIVDAPVMPELPSEADWSIFVNEVEAVAEGMPTEVSEVPVWKAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 532 - protein, 853 aa, Artificial Sequence
  PtIP-83 polypeptide variant
MDYSTLYRDLNQISMPLDRVEFSEVMVIHRMYLRLSDLNVGQLEGAERVKRLYVFADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLINQMAQVAQNYDREFKQFKLFIIQNQILGSYLLQQNRAFADREVQMESFHSAVISQRRQELDDAIAKMDRLSLQMEEEDRAMEQARKEMEEGLKQFQNEQVARAVFAVLSAVAQIGLAFLTAGATAPGAVASAGQAVSIAGQAAQGLRRVVEILEGLEAVMEVVAAIKHLVDALDQVSQIVDAPPMPDMPSEADWSIFVNEIEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQAGMSSFPSSWSRVRIRHLEMHFVKEASGIGGEIIHQPATQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 533 - protein, 852 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEITAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGEHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAIKHLVDALDQVSQIVDAPPMPDMPSEADWSIFVNEIEAVAEGMPTEVSEVPVWRAKCKNVAALGREMSITAVQMSELQYDIWVQGMMRDMARSQADRLAAIQPADLTNYLEMATQMDMRTTRMLLGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 534 - protein, 852 aa, Artificial Sequence; identical to SEQ ID NO: 521
  PtIP-83 polypeptide variant

SEQ ID NO: 535 - protein, 852 aa, Artificial Sequence
  PtIP-83 polypeptide variant
MDYSTLYRDLNQISMPLDRVEFSEVMVIHRMYLRLSDLNVGELPGAERVKRLYVFADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAIKHLVDALDQVSQIVDAPPMPDMPSEADWSIFVNEIEAVAEGMPTEVSEVPAWKAKCKNVAALGREMSITAVQMSELQYDIWVQGMMRDMARSQADRLAAIQPADLTNYLEMATQMDMRTTRMLLGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANKFMQMTPFTRWRLRLSASAKENVGLAFPTATALDSTTEIAITFHVTAIRQIDWRQEEE

SEQ ID NO: 536 - protein, 853 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGEHLNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 537 - protein, 852 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNRQVANALFAVLSAVAQIGLAFLTAGATAPGAAASAAQAVNIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRHDEE

SEQ ID NO: 538 - protein, 853 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNRAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 539 - protein, 852 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQGLRRVVEILEQLEAVMEVVAAVKDLVDSLEQVGQIVDAPVMPELPSEADWSIFVNEIEAVAEGMPTEVSEVPVWRAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGDSTLTNEPSEQFANKFMQMTPFTHWRLRLSASAAENKGLAFPTATAPDSTTEIAITFHVTAIRQIDWRQEEE

SEQ ID NO: 540 - protein, 852 aa, Artificial Sequence
  PtIP-83 polypeptide variant
MDYSTLYRDLNQISMPLDRVEFSEVMVIHRMYLRLSDLNVGQLEGAEKVKRLYVLADVVELATFAHPQLLNTRMPGSVTVIILCRLLQWPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMVRIGLVVPQLQYRMYGSLINQMAQVAQNYDREFKQFKLFIIQNQILGSYLLQQNRAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAIKHLVDALDQVSQIVDAPPMPDMPSEAGWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 541 - protein, 853 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGLLRDIAQSHADRLAAIQPANLTNYLEMAIQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHRPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 542 - protein, 865 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAIKHLVDALDQVSQIVDAPPMPDMPSEADWSIFVNEIEAVAEGMPTEVSEVPAWKAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 543 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLIRQMAQVAQNYDQDFRQLKLFIAQNQILGSYLLQQNKAFADREVQMESFHSAVISQRREELDDAIAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAIKHLVDALDQVSQIVDAPPMPDMPSEADWSIFVNEIEAVAEGMPTEVSEVPAWKAKCKNVAALGREMSITAVQMSELQYDIWVQGMMRDMARSQADRLAAIQPADLTNYLEMAIQMDMRTTRMLLGLLNILRIQNAALRYEYLLMPTELTTWPLGMDTVGDLLIAQENAALIGLMQLGPPSDFTSRHVVKGIPVSLLLDGGDWEFEIPVQGGMSSFPSSWTRVRIRHLEMHFVQEASGGGEIIHQPTTQTGTVYILLQGSTIFHDRRRDQVLPFQAAAPLNYHYAYRLDTGDSTLTNEPSEQFANKFMQMTPFTRWRLRLSASAAENKGLAFPTATAPDSTTEIAITFHVTAIRQIDWRQEEE

SEQ ID NO: 544 - protein, 851 aa, Artificial Sequence; identical to SEQ ID NO: 522
  PtIP-83 polypeptide variant

SEQ ID NO: 545 - protein, 853 aa, Artificial Sequence; identical to SEQ ID NO: 532
  PtIP-83 polypeptide variant

SEQ ID NO: 546 - protein, 852 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 547 - protein, 852 aa, Artificial Sequence
  PtIP-83 polypeptide variant
MDYSTLYRDLNQISMPLDRVEFSEVMVIHRMYVRLADLNVGQLPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACHPSPDVVSAVGVHVNWLNEVLLRVVQKESQLQGTEAYNECLALLGRIQCVMKMGPFVSVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAAASAAQAVNIAGQAAQGLRRVVEILEQLEAVMEVVAAVKDLVDSLEQVGQIVDAPVMPELPSEADWSIFVNEVEAVAEGMPTEVSEVPVWKAKCKNVAALGREMSITAVQMSELQYDIWVQGMMRDIAQSHADRLAAIQPANLTNYLEMAIQMDMRTTRILIGLLNILRIQNAALRYEYLLMPTELTTWPLGMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGDSTLTNEPSEQFANKFMQMTPFTRWRLRLSASAAENKGLAFPTATAPDSTTEIAITFHVTAIRQIDWRHDEE

SEQ ID NO: 548 - protein, 852 aa, Artificial Sequence
  PtIP-83 polypeptide variant
MDYSTLYRDLNQISMPLDRVEFSEVMVIHRMYLRLSDLNVGELPGAERVKRLYVFVDVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLINQMAQVAQNYDQDFRQLKLFIAQNQILGSYLLQQNKAFADREVQMESFHSAVISQRRQELDDAIAKMDRLSLQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRILIGLLNIMRIQNAALMYEYLLTPTQLTAWPLRMDTVANLLITHESAALSGLAQLGPPSDFTSRHVVKDIPVNLLLDGEDWEFEIPVQAGMSSFPSSWSRVRIRHLEMHFVKEASGGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATALDSTTQIVITFHVTAIRQIDWRHEEE

SEQ ID NO: 549 - protein, 855 aa, Artificial Sequence
  PtIP-83 polypeptide variant
MALVDYGKLFEDLNQISMPLDRVEFSEVMVIHRMYLRLSDLNVGELPGAERVKRLYVFADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAAASAAQAVNIAGQAAQALRRVVEILEGLEAVMEVVAAIKHLVDALDQVSQIVDAPPMPDMPSEADWSIFVNEIEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANKFMQMTPFTRWRLRLSASAKENAGLAFPTATALDSTTQIVITFHVTAIRQIDWRHDEE

SEQ ID NO: 550 - protein, 852 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACHPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHAAVISQRREELDDAIAKMDRLSLQMEEEDRAMEQARKEMEEGLKQFQNEQVARAVFAVLSAVAQIGLAFLTAGATAPGAAASAAQAVNIAGQAAQALRRVVEILEGLEAVMEVVAAIKHLVDALDQVSQIVDAPPMPDMPSEADWSIFVNEIEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAKENAGLAFPTATALDSTTQIVITFHVTAIRQIDWRHDEE

SEQ ID NO: 551 - protein, 852 aa, Artificial Sequence
  PtIP-83 polypeptide variant
MDYSTLYRDLNQISMPLDRVEFSEVMVIHRMYLRLSDLNVGELPGAERVKRLYVLADVVELAAFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGLLRDIAQSHADRLAAIQPANLTNYLEMAIQMDMRTTRMLLGLLNIMRIQNAALMYEYLLMPTELTTWPLGMDTVGDLLIAQENAALIGLMQLGPSSDFTSRHVVKDIPVNLLLDGEDWEFEIPVQGGMSSFPSSWTRVRIRHLEMHFVQEASGGGEIIHQPTTQTGTVYILLQGSTVFHDRRREEVMTFQAAVPLNYHYAYRLDTGEATLTNEPSEQFANTFMQMTPFTHWRLRLSASAAENKGLAFPTATALDSTTQIVITFHVTAIRQIDWRQEEE

SEQ ID NO: 552 - protein, 853 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPDVVSAVGEHLNWLNEVLLRVVQKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRRQELDDAIAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTELTTWPLGMDTVGDLLIAQENAALIGLMQLGPSSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAKENAGLAFPTATALDSTTQIVITFHVTAIRQIDWRQEEE

SEQ ID NO: 553 - protein, 854 aa, Artificial Sequence
  PtIP-83 polypeptide variant
MDYSTLYRDLNQISMGVLDRVEFSEVMVIHRMYLRLSDLNVGELPGAERVKRLYVLADVVELATFAHPQLLNTRMPGSVTVIILCRLLQFPTDGSFAAWLELPFMKLHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAVASAGQAVSIAGQAAQGLRRVVEILEGLEAVMEVVAAIKHLVDALDQVSQIVDAPPMPDMPSEADWSIFVNEIEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLRMDTVANLLITHESAALSGLAQLGPSSDFTSRHVVKDIPVNLLLDGEDWEFEIPVQAGMSSFPSSWSRVRIRHLEMHFVKEASGIGGEIIHQPTTQTGTVYILLQGSTVFHDRRREEVMTFQAAVPLNYHYAYRLDTGEATLTNEPSEQFANTFMQMTPFTRWRLRLSASAKENAGLAFPTATALDSTTQIVITFHVTAIRQIDWRHDEE

SEQ ID NO: 554 - protein, 852 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILLGMQTTVHIAELVKACHPSPDVVSAVGVHLNWLNKLLLPLKESTQLQGSEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVSIAGQAAQGLRRVVEILEQLEAVMEVVAAVKDLVDSLEQVGQIVDAPVMPELPSEADWSIFVNEVEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTQLTTWPLGMDTVGDLLIVQENAALIGLMQLGPPSDFTSRHVVKGIPVSLLLDGGDWEFEIPVQGGMSSFPSSWTRVRIRHLEMHFVQEASGIGGEIIHQPTTQTGTVYILLQGSTVFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 555 - protein, 852 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLINQMAQVAQNYDREFKQFKLFIIQNQILGSYLLQQNRAFADREVQMESFHSAVISQRREELDDAIAKMDRLSLQMEAESSAMEQAKKEMEEGLKQFQNEQVARAVFAVLKSVAMIALAFVTAGATAPGAAASAAQAVSIAGQAAQALRRVVEILEGLEAVMEVVAAVKDLVDALDQVSQIVDAPPMPDMPSEADWSIFVNEIEAVAEGMPTEVSEVPAWKAKCKNVAALGREMCITAEQISQLQYDIWVQGLLRDIARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 556 - protein, 853 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAVKDLVDSLEQVGQIVDAPVMPELPSEADWSIFVNEIEAVAEGMPTEVSEVPAWKAKCKNVAALGREMCITAEQISQLQYDIWVQGLLRDIAQSHADRLAAIQPADLTNYLEMATQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWSRVRIRHLEMHFVKEASGIGGEIIHQPTTQTGTVYILLQGSTIFHDRRRDQVLPFQAAAPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 557 - protein, 853 aa, Artificial Sequence; identical to SEQ ID NO: 552
  PtIP-83 polypeptide variant

SEQ ID NO: 558 - protein, 852 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNRAFADREVQMESFHSAVISQRRQELDNTFAKMDRLSGQMEAESSAMEQAKKEMDEGLRQFQNRQVANALFAVLSAVAQIGLAFLTAGATAPGAVASAGQAVSIAGQAAQGLRRVVEILEGLEAVMEVVAAVKDLVDSLEQVGQIVDAPVMPELPSEADWSIFVNEVEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVGDLLITQENAALIGLMQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGDSTLTNEPSEQFANKFMQMTPFTRWRLRLSASAKENAGLAFPTATALDSTTQIVITFHVTAIRQVDWRHDEE

SEQ ID NO: 559 - protein, 852 aa, Artificial Sequence
  PtIP-83 polypeptide variant
MDYSTLYRDLNQISMPLDRVEFSEVMVIHRMYLRLSDLNVGQLEGAERVKRLYVFADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRREELDNTFAKMDRLSLQMEAESSAMEQAKKEMDEGLRQFQNRQVANALFAVLKSVAMIALAFVTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQISQLQYDICVQGMMRDMARSQADRLAAIQPADLTNYLEMATQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTVYILLQGSTVFHDRRREEVMTFQAAVPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 560 - protein, 853 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQAKKEMDEGLKQFQNEQVARAVFAVLKSVAMIALAFVTAGATAPGAVASAGQAVSIAGQAAQGLRRVVEILEGLEAVMEVVAAIKHLVDALDQVSQIVDAPPMPDMPSEADWSIFVNEVEAVAEGMPTEVSEVPVWRAKCKNVAALGREMSITAVQMSELQYDIWVQGMMRDMARSQTDRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 561 - protein, 853 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQEFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFVTAGATAPGAVASAGQAVSIAGQAAQGLRRVVEILEQLEAVMEVVAAIKHLVDALDQVSQIVDAPPMPDMPSEADWSIFVNEIEAVAEGMPTEVSEVPVWKAKCKNVAALGREMCITAVQMSELQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGEATLTNEPSEQFANTFMQMTPFTHWRLRLSASAAENKGLAFPTATALDSTTQIVITFHVTAIRQIDWRQEEE

SEQ ID NO: 562 - protein, 852 aa, Artificial Sequence
  PtIP-83 polypeptide variant
MDYSTLYRDLNQISMPLDRVEFSEVMVIHRMYLRLSDLNVGQLEGAEKVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRREELDDAIAKMDRLSLQMEEEDRAMEQARKEMEEGLKQFQNEQVARAVFAVLKSVAMIALAFVTAGATAPGAAASAAQAVNIAGQAAQALRRVVEILEQLEAVMEVVAAVKDLVDSLEQVGQIVDAPVMPELPSEADWSIFVNEVEAVAEGMPTEVSEVPAWKAKCKNVAALGREMSITAEQISQLQYDIWVQGLLRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANKFMQMTPFTRWRLRLSASAAENKGLAFPTATAPDSTTEIAITFHVTAIRQIDWRQEEE

SEQ ID NO: 563 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRRQELDDAIAKMDRLSGQMEAESSAMEQAKKEMDEGLRQFQNRQVANALFAVLSAVAQIGLAFLTAGATAPGAVASAGQAVSIAGQAAQGLRRVVEILEGLEAVMEVVAAVKDLVDSLEQVGQIVDAPVMPELPSEADWSIFVNEVEAVAEGMPTEVSEVPVWRAKCKNVAALGREMSITAVQISQLQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKGIPVSLLLDGGDWEFEIPVQAGMSSFPSSWSRVRIRHLEMHFVQEASGIGGEIIHQPATQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 564 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSLQMEEEDRAMEQAKKEMDEGLRQFQNRQVANALFAVLSAVAQIGLAFLTAGATAPGAVASAGQAVSIAGQAAQGLRRVVEILEGLEAVMEVVAAIKHLVDSLEQVGQIVDAPVMPELPSEADWSIFVNEVEAVAEGMPTEVSEVPVWKAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQGGMSSFPSSWTRVRIRHLEMHFVKEASGIGGEIIHQPATQTGTVYILLQGSTIFHDRRREEVLPFQAAAPLNYHYAYRLDTGEATLTNEPSEQFANTFMQMTPFTRWRLRLSASAAENKGLAFPTATAPDSTTEIAITFHVTAIRQIDWRQEEE

SEQ ID NO: 565 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHSAVISQRREELDNTFAKMDRLSLQMEEEDRAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPAWKAKCKNVAALGREMCITAEQISQLQYDIWVQGMMRDMARSQADRLAAIQPADLTNYLEMATQMDMRTTRMLLGLLNILRIQNAALRYEYLLMPTELTTWPLGMDTVGDLLIAHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRHDEE

SEQ ID NO: 566 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHSAVISQRRQELDDAIAKMDRLSGQMEAESSAMEQAKKEMDEGLRQFQNRQVANALFAVLSAVAMIALAFVTAGATAPGAVASAGQAVSIAGQAAQGLRRVVEILEGLEAVMEVVAAVKDLVDSLEQVGQIVDAPVMPELPSEADWSIFVNEVEAVAEGMPTEVSEVPVWKAKCKNVAALGREMSITAVQMSELQYDIWVQGMMRDMARSHADRLAAIQPANLTNYLEMAIQMDMRTTRMLLGLLNILRIQNAALRYEYLLTPTELTTWPLGMDTVGDLLIAQENAALIGLMQLGPPSDFTSRHVVKGIPVSLLLDGGDWEFEIPVQGGMSSFPSSWSRVRIRHLEMHFVKEASGIGGEIIHQPTTQTGTVYILLQGSTVFHDRRREEVMTFQAAVPLNYHYAYRLDTGDSTLTNEPSEQFANKFMQMTPFTRWRLRLSASAKENAGLAFPTATAPDSTTEIVITFHVTAIRQIDWRHDEE

SEQ ID NO: 567 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRRQELDDAIAKMDRLSLQMEAEDRAMEQAKKEMDEGLKQFQNRQVANALFAVLSAVAQIGLAFVTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGLLRDIAQSHADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQGGMSSFPSSWSRVRIRHLEMHFVQEASGGGEIIHQPATQTGTIHILLQGSTVFHDRRRDQVLPFQAAAPLNYHYAYRLDTGEATLTNEPSEQFANKFMQMTPFTRWRLRLSASAKENAGLAFPTATAPDSTTEIAITFHVTAIRQIDWRQEEE

SEQ ID NO: 568 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFADREVQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVSQIVDAPPMPDMPSEADWSIFVNEVEAVAEGMPTEVSEVPVWRAKCKNVAALGREMSITAEQISQLQYDIWVQGMMRDMARSQADRLAAIQPADLTNYLEMATQMDMRTTRMLLGLLNILRIQNAALMYEYLLTPTQLTAWPLRMDTVANLLITHESAALSGLAQLGPPSDFTSRHVVKDIPVNLLLDGEDWEFEIPVQAGMSSFPSSWTRVRIRHLEMHFVQEASGGGEIIHQPTTQTGTVYILLQGSTIFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 569 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNKAFADREVQMESFHSAVISQRRQELDDAIAKMDRLSGQMEAESSAMEQAKKEMDEGLRQFQNRQVANALFAVLSAVAQIGLAFVTAGATAPGAVASAGQAVSIAGQAAQGLRRVVEILEGLEAVMEVVAAVKDLVDSLEQVGQIVDAPVMPELPSEADWSIFVNEVEAVAEGMPTEVSEVPVWRAKCKNVAALGREMCITAVQMSELQYDIWVQGLLRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKGIPVSLLLDGGDWEFEIPVQAGMSSFPSSWTRVRIRHLEMHFVKEASGGGEIIHQPATQTGTIYILLQGSTIFHDRRRDQVLPFQAAAPLNYHYAYRLDTGEATLTNEPSEQFANTFMQMTPFTRWRLRLSASAAENKGLAFPTATAPDSTTEIAITFHVTAIRQIDWRHDEE

SEQ ID NO: 570 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHSAVISQRREELDNTFAKMDRLSGQMEAESSAMEQAKKEMDEGLRQFQNRQVANALFAVLSAVAQIGLAFLTAGATAPGAAASAAQAVNIAGQAAQALRRVVEILEGLEAVMEVVAAIKHLVDALDQVSQIVDAPVMPELPSEADWSIFVNEVEAVAEGMPTEVSEVPAWKAKCKNVAALGREMSITAVQMSELQYDIWVQGLLRDMARSQADRLAAIQPADLTNYLEMATQMDMRTTRMLLGLLNILRIQNAALRYEYLLMPTELTTWPLGMDTVGDLLITHESAALSGLAQLGPPSDFTSRHVVKGIPVSLLLDGEDWEFEIPVQAGMSSFPSSWSRVRIRHLEMHFVKEASGIGGEIIHQPTTQTGTVYILLQGSTVFHDRRREEVMTFQAAAPLNYHYAYRLDTGEATLTNEPSEQFANTFMQMTPFTRWRLRLSASAKENAGLAFPTATAPDSTTEIAITFHVTAIRQIDWRHDEE

SEQ ID NO: 571 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDDAIAKMDRLSLQMEEEDRAMEQAKKEMDEGLRQFQNRQVANALFAVLSAVAQIGLAFVTAGATAPGAVASAGQAVSIAGQAAQGLRRVVEILEGLEAVMEVVAAVKDLVDSLEQVGQIVDAPVMPDMPSEADWSIFVNEVEAVAEGMPTEVSEVPVWRAKCKNVAALGREMCITAVQMSELQYDIWVQGMMRDMARSQADRLAAIQPADLTNYLEMATQMDMRTTRMLLGLLNIMRIQNAALMYEYLLTPTQLTAWPLRMDTVANLLITQENAALIGLMQLGPSSDFTSRHVVKDIPVNLLLDGEDWEFEIPVQGGMSSFPSSWSRVRIRHLEMHFVQEASGGGEIIHQPTTQTGTVYILLQGSTIFHDRRRDQVLPFQAAAPLNYHYAYRLDTGDSTLTNEPSEQFANKFMQMTPFTRWRLRLSASAAENKGLAFPTATAPDSTTEIAITFHVTAIRQIDWRQEEE

SEQ ID NO: 572 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRRQELDDAIAKMDRLSLQMEEEDRAMEQAKKEMDEGLRQFQNRQVANALFAVLSAVAQIGLASLTAGATAPGAVASAGQAVSIAGQAAQGLRRVVEILEGLEAVMEVVAAVKDLVDSLEQVGQIVDAPVMPELPSEADWSIFVNEVEAVAEGMPTEVSEVPVWRAKCKNVAALGREMCITAEQMSELQYDIWVQGMMRDMARSQADRLAAIQPADLTNYLEMAIQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVQEASGGGEIIHQPATQTGTVYILLQGSTIFHDRRREEVMTFQAAVPLNYHYAYRLDTGDSTLTNEPSEQFANKFMQMTPFTRWRLRLSASAKENAGLAFPTATAPDSTTEIAITFHVTAIRQIDWRHDEE

SEQ ID NO: 573 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRRQELDDAIAKMDRLSLQMEEEDRAMEQARKEMEEGLRQFQNEQVARAVFAVLKSVAMIALAFVTAGATAPGAVASAGQAVSIAGQAAQGLRRVVEILEGLEAVMEVVAAVKDLVDSLEQVGQIVDAPVMPELPSEADWSIFVNEVEAVAEGMPTEVSEVPAWRAKCKNVAALGREMCITAVQMSELQYDIWVQGMMRDMARSQADRLAAIQPADLTNYLEMAIQMDMRTTRMLLGLLNILRIQNAALRYEYLLMPTELTTWPLGMDTVGDLLIAHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRRDQVLPFQAAAPLNYHYAYRLDTGDSTLTNEPSEQFANKFMQMTPFTHWRLRLSASAKENAGLAFPTATALDSTTQIVITFHVTAIRQIDWRQEEE

SEQ ID NO: 574 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRRQELDNTFAKMDRLSGQMEEEDRAMEQARKEMEEGLRQFQNRQVANALFAVLSAVAQIGLAFLTAGATAPGAVASAGQAVSIAGQAAQGLRRVVEILEGLEAVMEVVAAVKDLVDSLEQVGQIVDAPVMPELPSEADWSIFVNEIEAVAEGMPTEVSEVPAWKAKCKNVAALGREMSITAVQMSELQYDIWVQGMMRDMARSQADRLAAIQPADLTNYLEMATQMDMRTTRMLLGLLNIMRIQNAALMYEYLLTPTQLTAWPLGMDTVGDLLITHESAALSGLAQLGPPSDFTSRHVVKGIPVSLLLDGGDWEFEIPVQGGMSSFPSSWSRVRIRHLEMHFVKEASGIGGEIIHQPATQTGTIYILLQGSTVFHDRRRDQVLPFQAAAPLNYHYAYRLDTGEATLTNEPSEQFANKFMQMTPFTRWRLRLSASAKENAGLAFPTATALDSTTQIVITFHVTAIRQIDWRQEEE

SEQ ID NO: 575 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHSAVISQRRQELDDAIAKMDRLSGQMEAESSAMEQAKKEMDEGLRQFQNRQVANALFAVLSAVAQIGLALLTAGATAPGAVASAGQAVSIAGQAAQGLRRVVETLEQLEAVMEVVAAVKDLVDSLEQVGQIVDAPPMPDMPSEADWSIFVNEIEAVAEGMPTEVSEVPAWKAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKGIPVSLLLDGGDWEFEIPVQGGMSSFPSSWSRVRIRHLEMHFVQEASGGGEIIHQPTTQTGTVYILLQGSTIFHDRRREEVMTFQAAVPLNYHYAYRLDTGEATLTNEPSEQFANKFMQMTPFTRWRLRLSASAKENAGLAFPTATALDSTTQIVITFHVTAIRQIDWRHDEE

SEQ ID NO: 576 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHSAVISQRRQELDDAIAKMDRLSLQMEEEDRAMEQARKEMEEGLRQFQNRQVANALFAVLKSVAMIALAFVTAGATAPGAVASAGQAVSIAGQAAQGLRRVVEILEQLEAVMEVVAAVKDLVDSLEQVGQIVDAPVMPDMPSEADWSIFVNEVEAVAEGMPTEVSEVPVWRAKCKNVAALGREMSITAVQMSELQYDIWVQGMMRDMARSQADRLAAIQPANLTNYLEMATQMDMRTTRMLLGLLNIMRIQNAALRYEYLLMPTELTTWPLGMDTVGDLLIAQENAALIGLMQLGPSSDFTSRHVVKGIPVSLLLDGGDWEFEIPVQGGMSSFPSSWSRVRIRHLEMHFVQEASGIGGEIIHQPATQTGTIYILLQGSTVFHDRRRDQVLPFQAAAPLNYHYAYRLDTGDSTLTNEPSEQFANKFMQMTPFTRWRLRLSASAKENAGLAFPTATALDSTTEIAITFHVTAIRQIDWRQEEE

SEQ ID NO: 577 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAAASAAQAVNIAGQAAQGLRRVVEILEGLEAVMEVVAAVKDLVDSLEQVGQIVDAPVMPELPSEADWSIFVNEVEAVAEGMPTEVSEVPAWKAKCKNVAALGREMSITAEQISQLQYDIWVQGMMRDMARSQADRLAAIQPADLTNYLEMATQMDMRTTRMLLGLLNILRIQNAALRYEYLLMPTELTTWPLGMDTVGDLLIAQENAALIGLAQLGPPSDFTSRHVVKGIPVSLLLDGGDWEFEIPVQAGMSSFPSSWTRVRIRHLEMHFVQEASGGGEIIHQPATQTGTIYILLQGSTVFHDRRREEVMTFQAAAPLNYHYAYRLDTGDSTLTNEPSEQFANTFMQMTPFTHWRLRLSASAKENAGLAFPTATALDSTTEIAITFHVTAIRQIDWRQEEE

SEQ ID NO: 578 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHSAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPDMPSEADWSIFVNEVEAVAEGMPTEVSEVPVWRAKCKNVAALGREMSITAVQMSELQYDIWVQGLLRDIAQSHADRLAAIQPANLTNYLEMATQMDMRTTRMLLGLLNILRIQNAALRYEYLLMPTELTTWPLGMDTVANLLITHESAALSGLAQLGPPSDFTSRHVVKGIPVSLLLDGGDWEFEIPVQGGMSSFPSSWTRVRIRHLEMHFVQEASGIGGEIIHQPTTQTGTVYILLQGSTTFHDRRRDQVLPFQAAAPLNYHYAYRLDTGDSTLTNEPSEQFANKFMQMTPFTRWRLRLSASAAENKGLAFPTATAPDSTTEIAITFHVTAIRQIDWRHDEE

SEQ ID NO: 579 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHSAVISQRRQELDDAIAKMDRLSLQMEEEDRAMEQARKEMEEGLKQFQNEQVARAVFAVLKSVAMIALAFVTAGATAPGAVASAGQAVSIAGQAAQGLRRVVEILEGLEAVMEVVAAVKDLVDSLEQVGQIVDAPPMPDMPSEADWSIFVNEVEAVAEGMPTEVSEVPAWKAKCKNVAALGREMCITAEQISQLQYDIWVQGMMRDMARSQADRLAAIQPADLTNYLEMAIQMDMRTTRMLLGLLNILRIQNAALRYEYLLMPTELTTWPLRMDTVANLLITHESAALSGLAQLGPPSDFTSRHVVKDIPVNLLLDGEDWEFEIPVQGGMSSFPSSWSRVRIRHLEMHFVKEASGIGGEIIHQPATQTGTVYILLQGSTVFHDRRREEVMTFQAAVPLNYHYAYRLDTGDSTLTNEPSEQFANKFMQMTPFTRWRLRLSASAKENAGLAFPTATAPDSTTEIAITFHVTAIRQIDWRHDEE

SEQ ID NO: 580 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDDAIAKMDRLSLQMEEEDRAMEQAKKEMDEGLRQFQNRQVANALFAVLSAVAQIGLAFVTAGATAPGAVASAGQAVSIAGQAAQGLRRVVEILEGLEAVMEVVAAVKDLVDSLEQVGQIVDAPVMPELPSEADWSIFVNEVEAVAEGMPTEVSEVPVWRAKCKNVAALGREMCITAEQISQLQYDIWVQGMMRDTAQSHADRLAAIQPADLTNYLEMATQMDMRTTRMLLGLLNILRIQNAALRYEYLLMPTELTTWPLGMDTVGDLLIAHESAALSGLAQLGPPSDFTSRHVVKDIPVSLLLDGEDWEFEIPVQAGMSSFPSSWSRVRIRHLEMHFVKEASGGGEIIHQPTTQTGTVYILLQGSTVFHDRRRDQVLPFQAAAPLNYHYAYRLDTGDSTLTNEPSEQFANKFMQMTPFTRWRLRLSASAKENAGLAFPTATAPDSTTEIAITFHVTAIRQIDWRHDEE

SEQ ID NO: 581 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHSAVISQRRQELDDAIAKMDRLSLQMEEEDRAMEQARKEMEEGLKQFQNEQVARAVFAVLKSVAMIALAFVTAGATAPGAVASAGQAVSIAGQAAQGLRRVVEILEGLEAVMEVVAAVKDLVDSLEQVGQIVDAPVMPELPSEADWSIFVNEIEAVAEGMPTEVSEVPVWRAKCKNVAALGREMCITAEQISQLQYDIWVQGMMRDMARSQADRLAAIQPADLTNYLEMATQMDMRTTRMLLGLLNILRIQNAALRYEYLLMPTELTTWPLGMDTVGDLLIAHESAALSGLAQLGPPSDFTSRHVVKGIPVSLLLDGEDWEFEIPVQGGMSSFPSSWTRVRIRHLEMHFVQEASGGGEIIHQPTTQTGTIYILLQGSTVFHDRRRDQVLPFQAAAPLNYHYAYRLDTGEATLTNEPSEQFANKFMQTTPFTHWRLRLSASAAENKGLAFPTATAPDSTTEIAITFHVTAIRQIDWRQEEE

SEQ ID NO: 582 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNKAFADREVQMESFHAAVISQRRQELDDAIAKMDRLSLQMEEEDRAMEQARKEMEEGLKQFQNEQVARAVFAVLKSVAMIALAFVTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMCITAEQISQLQYDIWVQGLLRDIARSQADRLAAIQPADLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWSRVRIRHLEMHFVQEASGGGEIIHQPATQTGTIYILLQGSTIFHDRRRDQVLPFQAAAPLNYHYAYRLDTGDSTLTNEPSEQFANKFMQMTPFTRWRLRLSASAAENKGLAFPTATAPDSTTEIAITFHVTAIRQIDWRQEEE

SEQ ID NO: 583 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHSAVISQRRQELDDAIAKMDRLSLQMEAESSAMEQAKKEMDEGLRQFQNRQVARAVFAVLKSVAMIALAFVTAGATAPGAVASAGQAVSIAGQAAQALRRVVEILEQLEAVMEVVAAVKDLVDSLEQVGQIVDAPVMPELPSEADWSIFVNEVEAVAEGMPTEVSEVPAWKAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKGIPVSLLLDGGDWEFEIPVQGGMSSFPSSWSRVRIRHLEMHFVQEASGGGEIIHQPATQTGTIYILLQGSTIFHDRRRDQVLPFQAAAPLNYHYAYRLDTGEATLTNEPSEQFANTFMQMTPFTHWRLRLSASAKENAGLAFPTATALDSTTQIVITFHVTAVRQIDWRHDEE

SEQ ID NO: 584 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFADREVQMESFHSAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYVIWVQGMMRDMARSQADRLAAIQPADLTNYLEMATQMDMRTTRMLLGLLNILRIQNAALMYEYLLTPTQLTAWPLRMDTVANLLITHESAALSGLAQLGPPSDFTSRHVVKGIPVSLLLDGGDWEFEIPVQGGMSSFPSSWSRVRIRHLEMHFVKEASGIGGEIIHQPATQTGTIYILLQGSTVFHDRRRDQVLPFQAAAPLNYHYAYRLDTGDSTLTNEPSEQFANTFMQMTPFTHWRLRLSASAAENKGLAFPTATAPDSTTEIAITFHVTAIRQIDWRQEEE

SEQ ID NO: 585 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRRQELDDAIAKMDRLSLQMEEEDRAMEQARKEMEEGLKQFQNEQVARAVFAVLKSVAMIALAFVTAGATAPGAAASAAQAVSIAGQAAQGLRRVVEILEGLEAVMEVVAAVKDLVDSLEQVGQIVDAPVMPELPSEADWSIFVNEVEAVAEGMPTEVSEVPVWRAKCKNVAALGREMCITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKGIPVSLLLDGGDWEFEIPVQGGMSSFPSSWSRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAKENAGLAFPTATAPDSTTEIAITFHVTAIRQIDWRHDEE

SEQ ID NO: 586 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHSAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEGLEAVMEVVAAIKHLVDALDQVSQIVDAPPMPDMPSEADWSIFVNEVEAVAEGMPTEVSEVPAWKAKCKNVAALGREMCITAEQISQLQYDIWVQGLLRDIAQSQADRLAAIQPADLTNYLEMATQMDMRTTRMLLGLLNILRIQNAALRYEYLLTPTQLTAWPLRMDTVANLLITHESAALSGLAQLGPPSDFTSRHVVKDIPVNLLLDGEDWEFEIPVQGGMSSFPSSWTRVRIRHLEMHFVQEASGGGEIIHQPATQTGTIYILLQGSTIFHDRRREEVMTFQAAVPLNYHYAYRLDTGDSTLTNEPSEQFANTFMQMTPFTRWRLRLSASAKENAGLAFPTATAPDSTTEIAITFHVTAIRQIDWRQEEE

SEQ ID NO: 587 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEEEDRAMEQAKKEMDEGLRQFQNRQVANALFAVLSAVAQIGLAFLTAGATAPGAVVSAGQAVSIAGQAAQGLRRVVEILEQLEAVMEVVAAVKDLVDSLEQVGQIVDAPVMPELPSEADWSIFVNEVEAVAEGMPTEVSEVPAWKAKCKNVAALGREMCITAEQISQLQYDIWVQGMMRDMARSQADRLAAIQPADLTNYLEMATQMDMRTTRMLLGLLNIMRIQNAALRYEYLLMPTELTTWPLGMDTVGDLLIAQENAALIGLMQLGPSSDFTSRHVVKGIPVSLLLDGGDWEFEIPVQGGMSSFPSSWTRVRIRHLEMHFVQEASGIGGEIIHQPTTQTGTVYILLQGSTIFHDRRRDQVLPFQAAAPLNYHYAYRLDTGEATLTNEPSEQFANTFMQMTPFTRWRLRLSAAAKENAGLAFPTATALDSTTQIVITFHVTAIRQIDWRHEEE

SEQ ID NO: 588 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEGLEAVMEVVAAVKDLVDSLEQVGQIVDAPVMPELPSEADWSIFVNEIEAVAEGMPTEVSEVPAWRAKCKNVAALGREMSITAVQMSELQYDIWVQGMMRDMARSQADRLAAIQPADLTNYLEMAIQMDMRTTRMLLGLLNILRIQNAALRYEYLLMPTELTTWPLGMDTVGDLLIAQENAALIGLAQLGPPSDFTSRHVVKGIPVSLLLDGGDWEFEIPVQGGMSSFPSSWSRVRIRHLEMHFVQEASGGGEIIHQPATQTGTIYILLQGSTVFHDRRRDQVLPFQAAAPLNYHYAYRLDTGEATLTNEPSEQFANKFMQMTPFTHWRLRLSASAAENKGLAFPTATAPDSTTEIVITFHVTAIRQIDWRQEEE

SEQ ID NO: 589 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEGLEAVMEVVAAIKHLVDALEQVGQIVDAPPMPDMPSEADWSIFVNEVEAVAEGMPTEVSEVPAWKAKCKNVAALGREMSITAVQMSELQYDIWVQGLLRDIARSQADRLAAIQPADLTNYLEMATQMDMRTTRMLLGLLNILRIQNAALRYEYLLMPTELTTWPLGMDTVGDLLITHESAALSGLAQLGPPSDFTSRHVVKGIPVSLLLDGGDWEFEIPVQGGMSSFPSSWTRVRIRHLEMHFVQEASGGGEIIHQPTTQTGTVYILLQGSTVFHDRRRDQVLPFQAAAPLNYHYAYRLDTGDSTLTNEPSEQFANKFMQMTPFTRWRLRLSASAKENAGLAFPTATAPDSTTQIVITFHVTAIRQIDWRQEEE

SEQ ID NO: 590 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDDAIAKMDRLSLQMEEEDRAMEQARKEMEEGLKQFQNEQVARAVFAVLKSVAQIGLAFVTAGATAPGAVASAGQAVSIAGQAAQGLRRVVEILEGLEAVMEVVAAVKDLVDSLEQVGQIVDAPVMPELPSEADWSIFVNEVEAVAEGMPTEVSEVPAWKAKCKNVAALGREMSITAEQMSELQYDIWVQGMMRDMARSQADRLAAIQPADLTNYLEMATQMDMRTTRMLLGLLNIMRIQNAALRYEYLLMPTELTTWPLGMDTVGDLLITHESAALSGLAQLGPPSDFTSRHVVKGIPVSLLLDGGDWEFEIPVQGGMSSFPSSWSRVRIRHLEMHFVKEASGGGEIIHQPATQTGTIYILLQGSTIFHDRRREEVMTFQAAVPLNYHYAYRLDTGDSTLTNEPSEQFANTFMQMTPFTRWRLRLSASAAENKGLAFPTATAPDSTTEIVITFHVTAIRQIDWRQEEE

SEQ ID NO: 591 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLIRQMAQVAQNYDREFKQFKLFIIQNQILGSYLLQQNRAFAERELQMESFHAAVISQRRQELDDAIAKMDRLSLQMEEEDRAMEQARKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEIEAVAEGMPTEVSEVPVWRAKCKNVAALGREMCITAVQMSELQYDIWVQGLLRDMARSQADRLAAIQPADLTNYLEMATQMDMRTTRMLLGLLNILRIQNAALRYEYLLMPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 592 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSDFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAEREVQMESFHSAVISQRRQELDNTFAKMDRLSLQMEEEDRAMEQARKEMEEGLKQFQNEQVARAVFAVLKSVAMIALAFVTAGATAPGAVASAGQAVSIAGQAAQALRRVVEILEGLEAVMEVVAAVKDLVDSLEQVGQIVDAPVMPELPSEADWSIFVNEVEAVAEGMPTEVSEVPAWKAKCKNVAALGREMCITAVQMSELQYDIWVQGMMRDMARSQADRLAAIQPADLTNYLEMATQMDMRTTRILIGLLNILRIQNAALMYEYLLTPTQLTAWPLRMDTVANLLITHESAALSGLAQLGPPSDFTSRHVVKDIPVNLLLDGEDWEFEIPVQAGMSSFPSSWTRVRIRHLEMHFVKEASGIGGEIIHQPATQTGTVYILLQGSTIFHDRRREEVMTFQAAVPLNYHYAYRLDTGEATLTNEPSEQFANTFMQMTPFTHWRLRLSASAAENKGLAFPTATALDSTTQIVITFHVTAIRQIDWRHDEE

SEQ ID NO: 593 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEEEDRAMEQARKEMEEGLKQFQNEQVARAVFAVLKSVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWKAKCKNVAALGREMSITAVQMSELQYDIWVQGMMRDMARSQADRLAAIQPADLTNYLEMAIQMDMRTTRMLLGLLNILRIQNAALRYEYLLMPTELTTWPLGMDTVANLLITHESAALSGLAQLGPSSDFSSRHVVKGIPVSLLLDGGDWEFEIPVQAGMSSFPSSWSRVRIRHLEMHFVKEASGGGEIIHQPTTQTGTIYILLQGSTVFHDRRREEVMTFQAAVPLNYHYAYRLDTGEATLTNEPSEQFANKFMQMTPFTRWRLRLSASAKENAGLAFPTATALDSTTQIVITFHVTAIRQIDWRQEEE

SEQ ID NO: 594 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNKAFADREVQMESFHAAVISQRREELDNTFAKMDRLSGQMEAESSAMEQAKKEMDEGLRQFQNEQVARAVFAVLKSVAMIALAFVTAGATAPGAVASAGQAVSIAGQAAQGLRRVVEILEGLEAVMEVVAAVKDLVDSLEQVGQIVDAPVMPELPSEADWSIFVNEVEAVAEGMPTEVSEVPAWRAKCKNVAALGREMCITAVQISQLQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPPSDFTSRHVVKDIPVNLLLDGEDWEFEIPVQAGMSSFPSSWSRVRIRHLEMHFVQEASGGGEIIHQPTTQTGTVYILLQGSTIFHDRRRDQVLPFQAAAPLNYHYAYRLDTGEATLTNEPSEQFANTFMQMTPFTHWRLRLSASAAENKGLAFPTATAPDSTTEIAITFHVTAIRQIDWRHDEE

SEQ ID NO: 595 - protein, 682 aa, Artificial Sequence
  PtIP-83 polypeptide variant
MDYSTLYRDLNQISMPLDRVEFSEVMVIHRMYVRLADLNVGELPGAERVKRLYVLADVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMCITAVQMSELQYDIWVQGMMRDIAQSHADRLAAIQPANLTNYLEMATQMDMRTTRMLLGLLNILRIQNAALRYEYLLMPTELTTWPLGMDTVGDLLIAQENAALIGLMQLGPSSDFTSRHVVKGIPVSLLLDGGDWEFEIPVQGGMSSFPSSWSRVRIRHLEMHFVKEASGIGGEIIHQPTTQTGTVYILLQGSTVFHDRRREEVMTFQAAVPLNYHYAYRLDTGDSTLTNEPSEQFANTFMQMTPFTRWRLRLSASAAENKGLAFPTATAPDSTTEIAITFHVTAIRQIDWRHDEE

SEQ ID NO: 596 - protein, 855 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTTVHIAELVKACHPSPDVVSAVGEHLNWLNEVLLRVVQKESQLQGTEAYNECLALLGRIQCVMKMGPFVSVVPQLQYRMYGSLINQMAQVAQNYDQDFRQLKLFIAQNQILGSYLLQQNRAFADREVQMESFHSAVISQRRQELDDAIAKMDRLSLQMEEEDRAMEQAKKEMDEGLRQFQNRQVANALFAVLSAVAQIGLAFLTAGATAPGAVASAGQAVSIAGQAAQGLRRVVEILEGLEAVMEVVAAVKDLVDSLEQVGQIVDAPVMPELPSEADWSIFVNEVEAVAEGMPTEVSEVPVWKAKCKNVAALGREMSITAEQMSELQYDIWVQGLMRDMARSQADRLAAIQPADLTNYLEMATQMDMRTTRMLLGLLNIMRIQNAALRYEYLLMPTELTTWPLGMDTVGDLLIAQENAALIGLMQLGPPSDFTSRHVVKGIPVSLLLDGGDWEFEIPVQAGMSSFPSSWTRVRIRHLEMHFVKEASGIGGEIIHQPTTQTGTVYILLQGSTIFHDRRRDQVLPFQAAAPLNYHYAYRLDTGEATLTNEPSEQFANTFMQMTPFTRWRLRLSASAKENAGLAFPTATALDSTTQIVITFHVTAIRQIDWRHDEE

SEQ ID NO: 597 - protein, 853 aa, Artificial Sequence
  PtIP-83 polypeptide variant
MDYSTLYRDLNQISMPLDRVEFSEVMVIHRMYVRLADLNVGQLEGAEKVKRLYVLADVVELATFAHPQLLNTRMPGSVTVIILCRLLQFPTDGSFAAWLELPFMELHTLIGQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPDVVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHAAVISQRRQELDDAIAKMDRLSLQMEEEDRAMEQAKKEMDEGLRQFQNRQVANALFAVLSAVAQIGLAFLTAGATAPGAVASAGQAVSIAGQAAQGLRRVVEILEGLEAVMEVVAAVKDLVDSLEQVGQIVDAPVMPELPSEADWSIFVNEVEAVAEGMPTEVSEVPVWRAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGIGGEIIHQPTTQTGTIYILLQGSTVFHDRRREEVMTFQAAVPLNYHYAYRLDTGDSTLTNEPSEQFANTFMQVTPFTRWRLRLSASAKENAGLAFPTATALDSTTQIVITFHVTAIRQIDWRHDEE

SEQ ID NO: 598 - protein, 855 aa, Artificial Sequence
  PtIP-83 polypeptide variant
MALVDYGKLFEDLNQISMPLDRVEFSEVMVIHRMYVRLADLNVGQLEGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLINQMAQVAQNYDQDFRQLKLFIAQNQILGSYLLQQNRAFAERELQMESFHAAVISQRREELDNTFAKMDRLSLQMEEEDRAMEQAKREMDEGLRQFQNEQVARAVFAVLKSVAMIALAFVTAGATAPGAVASAGQAVSIAGQAAQGLRRVVEILEGLEAVMEVVAAIKHLVDALDQVSQIVDAPVMPELPSEADWSIFVNEVEAVAEGMPTEVSEVPVWRAKCKNVAALGREMCITAEQISQLQYDIWVQGLLRDIAQSHADRLAAIQPADLTNYLEMATQMDMRTTRMLLGLLNILRIQNAALRYEYLLMPTELTTWPLGMDTVGDLLITHESAALSGLAQLGPPSDFTSRHVVKDIPVNLLLDGEDWEFEIPVQAGMSSFPSSWTRVRIRHLEMHFVQEASGGGEIIHQPTTQTGTVYILLQGSTVFHDRRREEVMTFQAAVPLNYHYAYRLDTGDSTLTNEPSEQFANKFMQMTPFTHWRLRLSASAAENKGLAFPTATAPDSTTEIAITFHVTAIRQIDWRHDEE

SEQ ID NO: 599 - protein, 855 aa, Artificial Sequence
  PtIP-83 polypeptide variant
MALVDYGKLFEDLNQISMPLDRVEFSEEMVIHRMYVRLADLNVGQLEGAEKVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDREFKQFKLFIIQNQILGSYLLQQNRAFAERELQMESFHSAVISQRRQELDDAIAKMDRLSLQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEIEAVAEGMPTEVSEVPAWKAKCKNVAALGREMCITAEQISQLQYDIWVQGLLRDIAQSHADRLAAIQPANLTNYLEMAIQMDMRTTRMLPGLLNILRIQNAALRYEYLLMPTELTTWPLGMDTVGDLLIAQENAALIGLMQLGPSSDFTSRHVVKGIPVSLLLDGGDWEFEIPVQAGMSSFPSSWSRVRIRHLEMHFVQEASGGGEIIHQPATQTGTIYILLQGSTVFHDRRRDQVLPFQAAAPPNYHYAYRLDTGDSTLTNEPSEQFANTFMQMTPFTHWRLRLSASAAENKGLAFPTATALDSTTEIAITFHVTAIRQIDWRHDEE

SEQ ID NO: 600 - protein, 856 aa, Artificial Sequence
  PtIP-83 polypeptide variant
MALVDYGKLFEDLNQISMGVLDRVESSEVMVIHRMYVRLADLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRFQCVMKMGPFVSVVPQLQYRMYGSLINQMAQVAQNYDQDFRQLKLFIAQNQILGSYLLQQNRAFAERELQMESFHAAVISQRRQELDDAIAKMDRLSLQMEAESSAMEQAKKEMDEGLRQFQNRQVANALFAVLSAVAQIALAFVTAGATAPGAVASAGQAVSIAGQAAQGLRRVVEILEGLEAVMEVVAAIKHLVDALDQVSQIVDAPPMPDMPSEADWSIFVNEIEAVAEGMPTEVSEVPVWRAKCKNVAALGREMCITAVQMSELQYDIWVQGMMRDMARSQADRLAAIQPADLTNYLEMAIQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTDEPSEQFANKFMQMTPFTRWRLRLSASAAENKGLAFPTATAPDSTTEIAITFHVTAIRQIDWRQEEE

SEQ ID NO: 601 - protein, 853 aa, Artificial Sequence
  PtIP-83 polypeptide variant
MDYSTLYRDLNQISMPLDRVEFSEVMEIHRMYVRLADLNVGQLEGAERVKRLYVFADVVELATFAHPQLLNTRMPGSATVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILLGMQTTVHIAELVKACHPSPDVVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHAAVISQRREELDNTFAKMDRLSGQMEEEDRAMEQARKEMEEGLRQFQNRQVANALFAVLSAVAQIGLAFLTAGATAPGAVASAGQAVSIAGQAAQGLRRVVEILEGLEAVMEVVAAIKHLVDALDQVSQIVDAPPMPDMPSEADWSIFVNEIEAVAEGMPTEVSEVPVWRAKCKNVAALGREMSITAVQMSELQYDIWVQGLLRDIAQSHADRLAAIQPANLTNYLEMATQMDMRTTRMLLGLLNIMRIQNAALMYEYLLTPTQLTAWPLRMDTVANLLITHESAALSGLAQLGPPSDFTSRHVVKGIPVSLLLDGGDWEFEIPVQAGMSSFPSSWSRVRIRHLEMHFVKEASGIGGEIIHQPATQTGTIYILLQGSTVFHDRRRDQVLPFQAAAPLNYHYAYRLDTGEATLTNEPSEQFANKFMQMTPFTRWRLRLSASAAENEGLAFPTATAPDSTTEIAITFHVTAIRQIDWRQEEE

SEQ ID NO: 602 - protein, 855 aa, Artificial Sequence
  PtIP-83 polypeptide variant
MALVDYGKLFEDLNQISMPLDRVEFSEVMVIHRMYVRLADLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPDVVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNRAFADREVQMESFHAAVISQRREELDNTFAKMDRLSLQMEEEDRAMEQARKEMEEGLKQFQNEQVARAVFAVLKSVAMIALAFVTAGATAPGAVASAGQAVSIAGQAAQGLRRVVEILEGLEAVMEVVAAIKHLVDALDQVSQIVDAPPMPDMPSEADWSIFVNEIEAVAEGMPTEVSEVPVWKAKCKNVAALGREMCITAEQISQLQYDIWVQGMMRDMARSQADRLAAIQPADLTNYLEMATQMDMRTTRILIGLLNIMRIQNAALRYEYLLMPTELTTWPLGMDTVGDLLIAQENAALSGLAQLGPPSDFTSRHVVKDIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGDSTLTNEPSEQFANTFMQMTPFTHWRLRLSASAKENAGLAFPTATALDSTTEIVITFHVTAIRQIDWRHEEE

SEQ ID NO: 603 - protein, 852 aa, Artificial Sequence
  PtIP-83 polypeptide variant
MDYSTLYRDLNQISMPLDRVEFSEVMVIHRMYVRLADLNVGQLEGAEKVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTTVHIAELVKACHPSPDVVSAVGVHLNWLNEVLLRVVQKESQLQGTEAYNECLALLGRIQCVMKMGPFVSVVPQLQYRMYGSLIRQMAQVAQNYDQDFRQLKLFIAQNQILGSYLLQQNRAFADREVQMESFHSAVISQRREELDNTFAKMDRLSGQMEAESSAMEQAKKEMEEGLRQFQNRQVANALFAVLSAVAQIGLAFLTAGATAPGAVASAGQAVSIAGQAAQGLRRVVEILEGLEAVMEVVAAVKDLVDSLEQVGQIVDAPVMPELPSEADWSIFVNEVEAVAEGMPTEVSEVPVWKAKCKNVAALGREMCITAVQMSELQYDIWVQGMMRDMARSQADRLAAIQPADLTNYLEMATQMDMRTTRILIGLLNIMRIQNAALMYEYLLTPTQLTAWPLRMDTVANLLITHESAALSGLAQLGPPSDFTSRHVVKDIPVNLLLDGGDWEFEIPVQGGMSSFPSSWTRVRIRHLEMHFVQEASGGGEIIHQPATQTGTVYILLQGSTIFHDRRREEVMTFQAAVPLNYHYAYRLDTGDSTLTNEPSEQFANKFMQMTPFTRWRLRLSASAKENAGLAFPTATALDSTTEIAITFHVTAIRQIDWRQEEE

SEQ ID NO: 604 - protein, 852 aa, Artificial Sequence
  PtIP-83 polypeptide variant
MDYSTLYRDLNQISMPLDRVEFSEVMVIHRMYVRLADLNVGQLEGAEKVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTTVHIAELVKACHPSPDVVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEGLEAVMEVVAAIKHLVDALDQVSQIVDAPPMPDMPSEADWSIFVNEIEAVAEGMPTEVSEVPAWKAKCKNVAALGREMCITAEQISQLQYDIWVQGLLRDMARSQADRLAAIQPADLTNYLEMATQMDMRTTRMLLGLLNIMRIQNAALMYEYLLMPTQLTTWPLGMDTVGDLLIAQENAALSGLAQLGPPSDFTSRHVVKGIPVSLLLDGGDWEFEIPVQGGMSSFPSSWTRVRIRHLEMHFVQEASGGGEIIHQPTTQTGTIYILLQGSTVFHDRRRDQVLPFQAAAPLNYHYAYRLDTGEATLTNEPSEQFANKFMQMTPFTRWRLRLSASAKENAGLAFPTATAPDSTTEIAITFHVTAIRQIDWRQEEE

SEQ ID NO: 605 - protein, 852 aa, Artificial Sequence
  PtIP-83 polypeptide variant
MDYSTLYRDLNQISMPLDRVEFSEVMVIHRMYVRLADLNVGELPGAERVKRLYVLADVVELATFAHPQLLNTRMPGSVTVIILCRLLQFPTDGSFAAWLELPFLELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACHPSPDVVSAVGVHVNWLNEVLLRVVQKESQLQGTEAYNECLALLGRIQCVMKMGPFVSVVPQLQYRMYGSLIRQMAQVAQNYDREFKQFKLFIIQNQILGSYLLQQNRAFADREVQMESFHSAVISQRREELDNTFAKMDRLSGQMEAESSAMEQAKKEMDEGLRQFQNRQVANALFAVLSAVAQIGLAFLTAGATAPGAVASAGQAVSIAGQAAQALRRVVEILEGLEAVMEVVAAIKHLVDSLEQVGQIVDAPVMPELPSEADWSIFVNEVEAVAEGMPTEVSEVPAWKAKCKNVAALGREMCITAEQMSELQYDIWVQGLLRDMARSQADRLAAIQPADLTNYLEMAIQMDMRTTRILIGLLNILRIQNAALRYEYLLTPTELTTWPLGMDTVGDLLITHESAALSGLAQLGPPSDFTSRHVVKGIPVSLLLDGGDWEFEIPVQGGMSSFPSSWTRVRIRHLEMHFVKEASGGGEIIHQPTTQTGTIYILLQGSTVFHDRRREEVMTFQAAVPLNYHYAYRLDTGEATLTNEPSEQFANKFMQMTPFTHWRLRLSASAAENKGLAFPTATAPDSTTEIAITFHVTAIRQIDWRQEEE

SEQ ID NO: 606 - protein, 856 aa, Artificial Sequence
  PtIP-83 polypeptide variant
MALVDYGKLFEDLNQISMGVLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPDVVSAVGEHLNWLNEVLLRVVQKESQLQGTEAYNECLALLGRIQCVMKMVRIGLVVPQLQYRMYGSLIRQMAQVAQNYDQDFRQLKLFIAQNQILGSYLLQQNKAFAERELQMESFHAAVISQRREELDNTFAKMDRLSGQMEAESSAMEQAKKEMDEGLRQFQNEQVARAVFAVLKSVAMIALAFVTAGATAPGAVASAGQAVNIAGQAAQALRRVVEILEGLEAVMEVVAAVKDLVDSLEQVGQIVDAPVMPELPSEADWSIFVNEIEAVAEGMPAEVSEVPAWKAKCKNVAALGREMCITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKGIPVSLLLDGGDWEFEIPVQGGMSSFPSSWSRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAKENAGLAFPTATALDSTTQIVITFHVTAIRQIDWRQEEE

SEQ ID NO: 607 - protein, 857 aa, Artificial Sequence
  PtIP-83 polypeptide variant
MALVDYGKLFEDLNQISMGVLDRVEFSEVMVIHRMYVRLADLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNRAFAERELQMESFHAAVISQRREELDNTFAKMDRLSGQMEAESSAMEQAKREMDEGLRQFQNRQVANALFAVLSAVAQIGLAFVTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGIGGEIIHQPTTQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRHDEE

SEQ ID NO: 608 - DNA, 60 bp, Artificial Sequence
  cDNA cloning primer
cgaaatctctcatctaagaggctggatcctaggatggattacagcacgctttacagggac

SEQ ID NO: 609 - DNA, 60 bp, Artificial Sequence
  cDNA cloning primer
ttaagttggccaatccagaagatggacaagtctagactactcctcctcttgccgccagtc

SEQ ID NO: 610 - DNA, 60 bp, Artificial Sequence; identical to SEQ ID NO: 608
  cDNA cloning primer

SEQ ID NO: 611 - DNA, 23 bp, Artificial Sequence
  cDNA cloning primer
caaggattgcattgctaggaagg

SEQ ID NO: 612 - DNA, 60 bp, Artificial Sequence; identical to SEQ ID NO: 609
  cDNA cloning primer

SEQ ID NO: 613 - DNA, 23 bp, Artificial Sequence
  cDNA cloning primer
ccttcctagcaatgcaatccttg

SEQ ID NO: 614 - DNA, 60 bp, Artificial Sequence; identical to SEQ ID NO: 608
  cDNA cloning primer

SEQ ID NO: 615 - DNA, 60 bp, Artificial Sequence
  cDNA cloning primer
aagttggccaatccagaagatggacaagtctagactactcctcctctttctcctcctgcc

SEQ ID NO: 616 - DNA, 59 bp, Artificial Sequence
  cDNA cloning primer
cgaaatctctcatctaagaggctggatcctaggatggccagtgtactggattacagcac

SEQ ID NO: 617 - DNA, 56 bp, Artificial Sequence
  cDNA cloning primer
ttaagttggccaatccagaagatggacaagtctagactactcctcctcgtgccgcc

SEQ ID NO: 618 - DNA, 60 bp, Artificial Sequence
  cDNA cloning primer
gaaatctctcatctaagaggctggatcctaggatggattacagcactctttacagggatc

SEQ ID NO: 619 - DNA, 60 bp, Artificial Sequence; identical to SEQ ID NO: 609
  cDNA cloning primer

SEQ ID NO: 620 - DNA, 60 bp, Artificial Sequence; identical to SEQ ID NO: 608
  cDNA cloning primer

SEQ ID NO: 621 - DNA, 55 bp, Artificial Sequence
  cDNA cloning primer
gttggccaatccagaagatggacaagtctagattagagtggcttcgccagtgtcg

SEQ ID NO: 622 - DNA, 60 bp, Artificial Sequence; identical to SEQ ID NO: 608
  cDNA cloning primer

SEQ ID NO: 623 - DNA, 60 bp, Artificial Sequence; identical to SEQ ID NO: 615
  cDNA cloning primer

SEQ ID NO: 624 - DNA, 60 bp, Artificial Sequence; identical to SEQ ID NO: 608
  cDNA cloning primer

SEQ ID NO: 625 - DNA, 60 bp, Artificial Sequence; identical to SEQ ID NO: 615
  cDNA cloning primer

SEQ ID NO: 626 - DNA, 26 bp, Artificial Sequence
  cDNA cloning primer
gcctttatcgactcctaattcacacc

SEQ ID NO: 627 - DNA, 22 bp, Artificial Sequence
  cDNA cloning primer
ccacattgtgcattacgaccac

SEQ ID NO: 628 - DNA, 26 bp, Artificial Sequence
  cDNA cloning primer
ccagtgatttgagttccttcattatg

SEQ ID NO: 629 - DNA, 24 bp, Artificial Sequence
  cDNA cloning primer
gaacagtacattgactgcatgtgc

SEQ ID NO: 630 - DNA, 51 bp, Artificial Sequence; identical to SEQ ID NO: 162
  mutagenesis primer

SEQ ID NO: 631 - DNA, 23 bp, Artificial Sequence
  mutagenesis primer
gcagccacaacctccatcacagc

SEQ ID NO: 632 - DNA, 52 bp, Artificial Sequence; identical to SEQ ID NO: 163
  mutagenesis primer

SEQ ID NO: 633 - DNA, 23 bp, Artificial Sequence
  mutagenesis primer
gctgtgatggaggttgtggctgc

SEQ ID NO: 634 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatatcgcatgtacaaagatctcattgatcgaatggtgcaagtggctcagagctacgaccaagacttcaagcagttgaagctgttcgtggaacaaaataagatacttgggagctatttgctagagcaaaacaaggcgtttgctgagaaggaaaaagacatggatgcttttcactcccaagtcattgatctcaggacttctgagcttgaaagcaccattgagagaatggatgacttaagcaaacaaatggaagaacaaaatgcagcaatggagcaagccaaagcggacatggacgcagggttgatagcgtatcaaaacaaacaagtcgcaaatgccgtctttgcggtcttgggggcgatcgccagtattggtctggcatttgcaactggcggggcaactgctcctggagccgtggcttccgcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 635 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagccgtggcttccgcaggagcagctgttaccgcagctgggaaggcagctgagggattgaagaaagtggtagagattcttgaaggcttacaagcggtgatggaggtcgtcgctgtcataaaagagctggtacagtccttacaggagatagggcagcttgtggatgcccctgagatgccagatctgccgtcggatgcagaatgggagatttttgtgaatgaagtggaggcagtagcagagcagatgccaacagaggtgacagaggtgcctgcttggaaggccaagtgcaagaatgtggcagcactaggccgagaaatgagcactatggcggcgcacattgcagagttgcagttcgagatacaagtgcaagaaatgttgcgcgagatcgcgaagaaacaggcagataggctgtcgtccatcaagcccgcagacttgacgaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 636 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcagacttgacgaactacttggagatggtgtccgaaatggacatgcgcacaacgcgcatgctgttggagctgattcgagtgctgtacatccagaacgcagcattgcagtacgaatatctgcagacaccggcgccattgaatgcatggccagtgacgatgcaaacggtgtgggggttgcttgtgcaacaagagacggccgcaattaacgggctgctgcagatgggggcgccctcggactacacacaagagtatgcggtgagagatgttcctgtgaggttgttactagggggtggagactgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 637 - DNA, 2604 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcccgtcacaagcacgggggaagtgtacatgctgctgcagagttctcgcttcttcgaggatcgcgccaagcgtgagaacgagttcattagctacgagggcggcatgggccttcagtatcagtatgcctaccgcttggccacgggcgacgccaccgtcaccaacgtccccagcgaggagtatgccaatacttttatgcgcctcgcacccttcactcgttggcgcctccgcctttcggcctccgcgcccgagaacaagggcctcgcatttccaaccgccaccttggccgatgccaccacacgaatcaaaatcacctttcacgtctctgccattcgccgtataagcaccagagtcgccgta

SEQ ID NO: 638 - DNA, 2598 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcactcgttggcgcctccgcctttcggcctccgcgcccgagaacaagggcctcgcatttccaaccgccaccttggccgatgccaccacacgaatcaaaatcacctttcacgtctctgccattcgccgtataagcaccagagtcgccgta

SEQ ID NO: 639 - DNA, 2601 bp, Artificial Sequence
  PtIP-83 polypeptide variant encoding polynucleotide
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatatcgcatgtacaaagatctcattgatcgaatggtgcaagtggctcagagctacgaccaagacttcaagcagttgaagctgttcgtggaacaaaataagatacttgggagctatttgctagagcaaaacaaggcgtttgctgagaaggaaaaagacatggatgcttttcactcccaagtcattgatctcaggacttctgagcttgaaagcaccattgagagaatggatgacttaagcaaacaaatggaagaacaaaatgcagcaatggagcaagccaaagcggacatggacgcagggttgatagcgtatcaaaacaaacaagtcgcaaatgccgtctttgcggtcttgggggcgatcgccagtattggtctggcatttgcaactggcggggcaactgctcctggagccgtggcttccgcaggagcagctgttaccgcagctgggaaggcagctgagggattgaagaaagtggtagagattcttgaaggcttacaagcggtgatggaggtcgtcgctgtcataaaagagctggtacagtccttacaggagatagggcagcttgtggatgcccctgagatgccagatctgccgtcggatgcagaatgggagatttttgtgaatgaagtggaggcagtagcagagcagatgccaacagaggtgacagaggtgcctgcttggaaggccaagtgcaagaatgtggcagcactaggccgagaaatgagcactatggcggcgcacattgcagagttgcagttcgagatacaagtgcaagaaatgttgcgcgagatcgcgaagaaacaggcagataggctgtcgtccatcaagcccgcagacttgacgaactacttggagatggtgtccgaaatggacatgcgcacaacgcgcatgctgttggagctgattcgagtgctgtacatccagaacgcagcattgcagtacgaatatctgcagacaccggcgccattgaatgcatggccagtgacgatgcaaacggtgtgggggttgcttgtgcaacaagagacggccgcaattaacgggctgctgcagatgggggcgccctcggactacacacaagagtatgcggtgagagatgttcctgtgaggttgttactagggggtggagactgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagag

SEQ ID NO: 640 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYKDLIDRMVQVAQSYDQDFKQLKLFVEQNKILGSYLLEQNKAFAEKEKDMDAFHSQVIDLRTSELESTIERMDDLSKQMEEQNAAMEQAKADMDAGLIAYQNKQVANAVFAVLGAIASIGLAFATGGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 641 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGAAVTAAGKAAEGLKKVVEILEGLQAVMEVVAVIKELVQSLQEIGQLVDAPEMPDLPSDAEWEIFVNEVEAVAEQMPTEVTEVPAWKAKCKNVAALGREMSTMAAHIAELQFEIQVQEMLREIAKKQADRLSSIKPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 642 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMVSEMDMRTTRMLLELIRVLYIQNAALQYEYLQTPAPLNAWPVTMQTVWGLLVQQETAAINGLLQMGAPSDYTQEYAVRDVPVRLLLGGGDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 643 - protein, 868 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPVTSTGEVYMLLQSSRFFEDRAKRENEFISYEGGMGLQYQYAYRLATGDATVTNVPSEEYANTFMRLAPFTRWRLRLSASAPENKGLAFPTATLADATTRIKITFHVSAIRRISTRVAV

SEQ ID NO: 644 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAPENKGLAFPTATLADATTRIKITFHVSAIRRISTRVAV

SEQ ID NO: 645 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYKDLIDRMVQVAQSYDQDFKQLKLFVEQNKILGSYLLEQNKAFAEKEKDMDAFHSQVIDLRTSELESTIERMDDLSKQMEEQNAAMEQAKADMDAGLIAYQNKQVANAVFAVLGAIASIGLAFATGGATAPGAVASAGAAVTAAGKAAEGLKKVVEILEGLQAVMEVVAVIKELVQSLQEIGQLVDAPEMPDLPSDAEWEIFVNEVEAVAEQMPTEVTEVPAWKAKCKNVAALGREMSTMAAHIAELQFEIQVQEMLREIAKKQADRLSSIKPADLTNYLEMVSEMDMRTTRMLLELIRVLYIQNAALQYEYLQTPAPLNAWPVTMQTVWGLLVQQETAAINGLLQMGAPSDYTQEYAVRDVPVRLLLGGGDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 646 - protein, 50 aa, artificial sequence
  amino acid sequence motif
  MISC_FEATURE (3)..(3): Xaa at position 3 is Asp or Glu
  MISC_FEATURE (17)..(17): Xaa at position 17 is Ile or Val
  MISC_FEATURE (33)..(33): Xaa at position 33 is Ala or Val
  MISC_FEATURE (41)..(41): Xaa at position 41 is Met or Val
  MISC_FEATURE (49)..(49): Xaa at position 49 is Ser or Cys
MPXMPSEADWSIFVNEXEAVAEGMPTEVSEVPXWKAKCKNXAALGREMXI

SEQ ID NO: 647 - protein, 50 aa, artificial sequence
  amino acid sequence motif
  MISC_FEATURE (10)..(10): Xaa at position 10 is Asn or Ser
  MISC_FEATURE (13)..(13): Xaa at position 13 is Lys or Asn
  MISC_FEATURE (25)..(25): Xaa at position 25 is Glu or Asp
  MISC_FEATURE (29)..(29): Xaa at position 29 is Phe or Leu
  MISC_FEATURE (34)..(34): Xaa at position 34 is Ile or Ala
  MISC_FEATURE (39)..(39): Xaa at position 39 is Leu or Phe
  MISC_FEATURE (48)..(48): Xaa at position 48 is Lys or Arg
PQLQYRMYGXLIXQMAQVAQNYDQXFKQXKLFIXQNQIXGSYLLQQNXAF

SEQ ID NO: 648 - protein, 50 aa, artificial sequence
  amino acid sequence motif
  MISC_FEATURE (25)..(25): Xaa at position 25 is Glu or Gly
  MISC_FEATURE (34)..(34): Xaa at position 34 is Pro or Leu
  MISC_FEATURE (39)..(39): Xaa at position 39 is Glu or Gln
  MISC_FEATURE (40)..(40): Xaa at position 40 is Ile or Val
NTFMQMTPFTRWRLRLSASASENAXLAFPTATAXDSTTXXVITFHVTAIR

SEQ ID NO: 649 - protein, 36 aa, artificial sequence
  amino acid sequence motif
  MISC_FEATURE (1)..(1): Xaa at position 1 is Asp or Asn
  MISC_FEATURE (10)..(10): Xaa at position 10 is Gly or Asp
  MISC_FEATURE (30)..(30): Xaa at position 30 is Ala or Gly
XFTSRHVVKXIPVSLLLDGEDWEFEIPVQXGMSSFP

SEQ ID NO: 650 - protein, 50 aa, artificial sequence
  amino acid sequence motif
  MISC_FEATURE (6)..(6): Xaa at position 6 is Ser or Ala
  MISC_FEATURE (8)..(8): Xaa at position 8 is Arg or Gln
  MISC_FEATURE (9)..(9): Xaa at position 9 is Ser or Thr
  MISC_FEATURE (11)..(11): Xaa at position 11 is Ile or Thr
  MISC_FEATURE (28)..(28): Xaa at position 28 is Asp or Glu
  MISC_FEATURE (37)..(37): Xaa at position 37 is Asp or Ala
  MISC_FEATURE (41)..(41): Xaa at position 41 is Phe or Tyr
  MISC_FEATURE (42)..(42): Xaa at position 42 is Gln or His
IIHQPXTXXGXVYILLQGSTIFHDRRRXEVMTFQAAXPLNXXYAYRLDTG

SEQ ID NO: 651 - protein, 50 aa, artificial sequence
  amino acid sequence motif
  MISC_FEATURE (2)..(2): Xaa at position 2 is His or Gln
  MISC_FEATURE (12)..(12): Xaa at position 12 is Ala or Val
  MISC_FEATURE (17)..(17): Xaa at position 17 is His or Tyr
  MISC_FEATURE (23)..(23): Xaa at position 23 is His or Gln
  MISC_FEATURE (30)..(30): Xaa at position 30 is Arg or Ser
  MISC_FEATURE (31)..(31): Xaa at position 31 is Met or Ile
  MISC_FEATURE (33)..(33): Xaa at position 33 is Ile or Leu
  MISC_FEATURE (38)..(38): Xaa at position 38 is Met or Ile
SXADRLAAIQPXDLTNXLEMATXMDMRTTXXLXGLLNXLRIQNAALMYEY

SEQ ID NO: 652 - protein, 44 aa, artificial sequence
  amino acid sequence motif
  MISC_FEATURE (1)..(1): Xaa at position 1 is Val or Leu
  MISC_FEATURE (20)..(20): Xaa at position 20 is Ser or Ala
  MISC_FEATURE (23)..(23): Xaa at position 23 is Asn or Asp
  MISC_FEATURE (28)..(28): Xaa at position 28 is Pro or Glu
  MISC_FEATURE (31)..(31): Xaa at position 31 is Glu or Gly
  MISC_FEATURE (32)..(32): Xaa at position 32 is Arg or Lys
  MISC_FEATURE (36)..(36): Xaa at position 36 is Val or Leu
  MISC_FEATURE (39)..(39): Xaa at position 39 is Phe or Leu
XDRVEFSEVMVIHRMYVRLXDLXVGELXGAXXVKRXYVXADVVE

SEQ ID NO: 653 - protein, 50 aa, artificial sequence
  amino acid sequence motif
  MISC_FEATURE (2)..(2): Xaa at position 2 is Asp or Glu
  MISC_FEATURE (23)..(23): Xaa at position 23 is Asn or Asp
  MISC_FEATURE (26)..(26): Xaa at position 26 is Ile or Phe
  MISC_FEATURE (30)..(30): Xaa at position 30 is Asp or Glu
  MISC_FEATURE (32)..(32): Xaa at position 32 is Leu or Met
  MISC_FEATURE (40)..(40): Xaa at position 40 is Asn or Ser
AXRELQMESFHSAVISQRRQELXTAXAKMXRXSLQMEEEXRAMEQAQKEM

SEQ ID NO: 654 - protein, 50 aa, artificial sequence
  amino acid sequence motif
  MISC_FEATURE (12)..(12): Xaa at position 12 is Ala or Val
  MISC_FEATURE (28)..(28): Xaa at position 28 is Ala or Gly
  MISC_FEATURE (38)..(38): Xaa at position 38 is Gly or Gln
  MISC_FEATURE (49)..(49): Xaa at position 49 is Val or Ile
FVTAGATAPGAXASAGQAVSIAGQAAQXLRRVVEILEXLEAVMEVVAAXK

SEQ ID NO: 655 - protein, 50 aa, artificial sequence
  amino acid sequence motif
  MISC_FEATURE (7)..(7): Xaa at position 7 is Ile or Thr
  MISC_FEATURE (10)..(10): Xaa at position 10 is Tyr or His
  MISC_FEATURE (13)..(13): Xaa at position 13 is Lys or Gln
  MISC_FEATURE (15)..(15): Xaa at position 15 is Glu or Gln
  MISC_FEATURE (34)..(34): Xaa at position 34 is Thr or Ile
  MISC_FEATURE (43)..(43): Xaa at position 43 is Val or Phe
  MISC_FEATURE (49)..(49): Xaa at position 49 is Ile or Val
DGMNWGXYIXGEXVXRSPLLPSNAILAVWADRCXITSARHNHXNAPGRXI

SEQ ID NO: 656 - protein, 50 aa, artificial sequence
  amino acid sequence motif
  MISC_FEATURE (1)..(1): Xaa at position 1 is Lys or Val
  MISC_FEATURE (2)..(2): Xaa at position 2 is Val or Lys
  MISC_FEATURE (3)..(3): Xaa at position 3 is Cys or Ala
  MISC_FEATURE (11)..(11): Xaa at position 11 is Met or Val
  MISC_FEATURE (31)..(31): Xaa at position 31 is Lys or Asn
  MISC_FEATURE (35)..(35): Xaa at position 35 is Leu or Met
  MISC_FEATURE (39)..(39): Xaa at position 39 is Ala or Glu
XXXRPPSPDMXSAVAEHALWLNDVLLQVVQXESQXQGTXPYNECLALLGR

SEQ ID NO: 657 - protein, 36 aa, artificial sequence
  amino acid sequence motif
  MISC_FEATURE (6)..(6): Xaa at position 6 is Val or Ala
  MISC_FEATURE (15)..(15): Xaa at position 15 is Ala or Gly
  MISC_FEATURE (27)..(27): Xaa at position 27 is Val or Leu
PTELTXWPLGMDTVXNLLIAQENAALXGLIQLGPSS

SEQ ID NO: 658 - protein, 30 aa, artificial sequence
  amino acid sequence motif
  MISC_FEATURE (4)..(4): Xaa at position 4 is Met or Thr
  MISC_FEATURE (5)..(5): Xaa at position 5 is His or Gln
  MISC_FEATURE (14)..(14): Xaa at position 14 is Ile or Val
  MISC_FEATURE (23)..(23): Xaa at position 23 is Ile or Thr
  MISC_FEATURE (29)..(29): Xaa at position 29 is Thr or Ala
RDQXXMPGSVTVIXLCRLLQFPXDGSQAXT

SEQ ID NO: 659 - protein, 26 aa, artificial sequence
  amino acid sequence motif
  MISC_FEATURE (12)..(12): Xaa at position 12 is Ser or Asn
  MISC_FEATURE (22)..(22): Xaa at position 22 is Leu or His
TSIPVEVVTDPXILLGMQTTVXIAEL

SEQ ID NO: 660 - protein, 26 aa, artificial sequence
  amino acid sequence motif
  MISC_FEATURE (5)..(5): Xaa at position 5 is Glu or Gln
  MISC_FEATURE (15)..(15): Xaa at position 15 is Val or Leu
  MISC_FEATURE (24)..(24): Xaa at position 24 is Met or Gln
  MISC_FEATURE (26)..(26): Xaa at position 26 is Ala or Gly
EGLRXFQNRQVARAXFAVLKAVAXIX

SEQ ID NO: 661 - protein, 19 aa, artificial sequence
  amino acid sequence motif
  MISC_FEATURE (2)..(2): Xaa at position 2 is Thr or Ser
  MISC_FEATURE (12)..(12): Xaa at position 12 is Gln or His
  MISC_FEATURE (14)..(14): Xaa at position 14 is Ala or Val
WXRVRIRHLEMXFXQEASG

SEQ ID NO: 662 - protein, 19 aa, artificial sequence
  amino acid sequence motif
  MISC_FEATURE (8)..(8): Xaa at position 8 is Glu or Asp
  MISC_FEATURE (14)..(14): Xaa at position 14 is Leu or Met
  MISC_FEATURE (15)..(15): Xaa at position 15 is Met or Ile
QISELQYXIWVQGXXRDIA

SEQ ID NO: 663 - protein, 36 aa, artificial sequence
  amino acid sequence motif
TFTLGSGVTGITSMHGEPSLDPWNGVSLDSASPTAF

SEQ ID NO: 664 - protein, 14 aa, artificial sequence
  amino acid sequence motif
MDYSTLYRDLNQIS

SEQ ID NO: 665 - protein, 19 aa, artificial sequence
  amino acid sequence motif
  MISC_FEATURE (7)..(7): Xaa at position 7 is Gln or Lys
  MISC_FEATURE (17)..(17): Xaa at position 17 is Val or Arg
  MISC_FEATURE (19)..(19): Xaa at position 19 is Ser or Glu
LRLPFMXLHARVIEQNXKX

SEQ ID NO: 666 - protein, 14 aa, artificial sequence
  amino acid sequence motif
  MISC_FEATURE (9)..(9): Xaa at position 9 is Gln or His
  MISC_FEATURE (10)..(10): Xaa at position 10 is Ile or Leu
  MISC_FEATURE (12)..(12): Xaa at position 12 is Gly or Asp
VDSLEQVGXXVXAP

SEQ ID NO: 667 - protein, 14 aa, artificial sequence
  amino acid sequence motif
  MISC_FEATURE (1)..(1): Xaa at position 1 is Ile or Val
  MISC_FEATURE (2)..(2): Xaa at position 2 is Glu or Gln
  MISC_FEATURE (3)..(3): Xaa at position 3 is Cys or Ala
  MISC_FEATURE (7)..(7): Xaa at position 7 is Ile or Met
  MISC_FEATURE (11)..(11): Xaa at position 11 is Val or Gly
  MISC_FEATURE (12)..(12): Xaa at position 12 is Ser or Leu
XXXVMKXGRFXXVV

SEQ ID NO: 668 - protein, 10 aa, artificial sequence
  amino acid sequence motif
  MISC_FEATURE (9)..(9): Xaa at position 9 is Glu or Gln
TLTNEPSEXF

SEQ ID NO: 669 - protein, 10 aa, artificial sequence
  amino acid sequence motif
LPRQSRNISF

SEQ ID NO: 670 - protein, 50 aa, artificial sequence
  amino acid sequence motif
  MISC_FEATURE (3)..(3): Xaa at position 3 is Asp or Glu
  MISC_FEATURE (6)..(6): Xaa at position 6 is Ser or Thr
  MISC_FEATURE (7)..(7): Xaa at position 7 is Glu or Asp
  MISC_FEATURE (17)..(17): Xaa at position 17 is Ile, Val or Leu
  MISC_FEATURE (33)..(33): Xaa at position 33 is Ala or Val
  MISC_FEATURE (35)..(35): Xaa at position 35 is Lys or Arg
  MISC_FEATURE (41)..(41): Xaa at position 41 is Met or Val
  MISC_FEATURE (49)..(49): Xaa at position 49 is Ser or Cys
MPXMPXXADWSIFVNEXEAVAEGMPTEVSEVPXWXAKCKNXAALGREMXI

SEQ ID NO: 671 - protein, 50 aa, artificial sequence
  amino acid sequence motif
  MISC_FEATURE (10)..(10): Xaa at position 10 is Asn or Ser
  MISC_FEATURE (13)..(13): Xaa at position 13 is Lys, Arg or Asn
  MISC_FEATURE (24)..(24): Xaa at position 24 is Gln or Arg
  MISC_FEATURE (25)..(25): Xaa at position 25 is Glu or Asp
  MISC_FEATURE (28)..(28): Xaa at position 28 is Gln or Arg
  MISC_FEATURE (29)..(29): Xaa at position 29 is Phe or Leu
  MISC_FEATURE (30)..(30): Xaa at position 30 is Lys or Arg
  MISC_FEATURE (34)..(34): Xaa at position 34 is Ile, Ala, Val or Leu
  MISC_FEATURE (39)..(39): Xaa at position 39 is Leu or Phe
  MISC_FEATURE (45)..(45): Xaa at position 45 is Gln or Glu
  MISC_FEATURE (48)..(48): Xaa at position 48 is Lys or Arg
PQLQYRMYGXLIXQMAQVAQNYDXXFKXXXLFIXQNQIXGSYLLXQNXAF

SEQ ID NO: 672 - protein, 50 aa, artificial sequence
  amino acid sequence motif
  MISC_FEATURE (2)..(2): Xaa at position 2 is Thr or Lys
  MISC_FEATURE (11)..(11): Xaa at position 11 is Arg or His
  MISC_FEATURE (21)..(21): Xaa at position 21 is Ser, Pro, Lys or Ala
  MISC_FEATURE (24)..(24): Xaa at position 24 is Ala or Lys
  MISC_FEATURE (25)..(25): Xaa at position 25 is Glu or Gly
  MISC_FEATURE (34)..(34): Xaa at position 34 is Pro or Leu
  MISC_FEATURE (39)..(39): Xaa at position 39 is Glu or Gln
  MISC_FEATURE (40)..(40): Xaa at position 40 is Ile or Val
  MISC_FEATURE (41)..(41): Xaa at position 41 is Val or Ala
NXFMQMTPFTXWRLRLSASAXENXXLAFPTATAXDSTTXXXITFHVTAIR

SEQ ID NO: 673 - protein, 36 aa, artificial sequence
  amino acid sequence motif
  MISC_FEATURE (1)..(1): Xaa at position 1 is Asp or Asn
  MISC_FEATURE (10)..(10): Xaa at position 10 is Gly or Asp
  MISC_FEATURE (14)..(14): Xaa at position 14 is Ser or Asn
  MISC_FEATURE (20)..(20): Xaa at position 20 is Glu or Gly
  MISC_FEATURE (30)..(30): Xaa at position 30 is Ala or Gly
XFTSRHVVKXIPVXLLLDGXDWEFEIPVQXGMSSFP

SEQ ID NO: 674 - protein, 50 aa, artificial sequence
  amino acid sequence motif
  MISC_FEATURE (6)..(6): Xaa at position 6 is Ser or Ala
  MISC_FEATURE (8)..(8): Xaa at position 8 is Arg or Gln
  MISC_FEATURE (9)..(9): Xaa at position 9 is Ser or Thr
  MISC_FEATURE (11)..(11): Xaa at position 11 is Ile or Thr
  MISC_FEATURE (12)..(12): Xaa at position 12 is Val or Ile
  MISC_FEATURE (21)..(21): Xaa at position 21 is Ile or Val
  MISC_FEATURE (28)..(28): Xaa at position 28 is Asp or Glu
  MISC_FEATURE (29)..(29): Xaa at position 29 is Glu or Gln
  MISC_FEATURE (31)..(31): Xaa at position 31 is Met or Leu
  MISC_FEATURE (33)..(33): Xaa at position 33 is Phe or Pro
  MISC_FEATURE (37)..(37): Xaa at position 37 is Asp, Ala or Val
  MISC_FEATURE (41)..(41): Xaa at position 41 is Phe or Tyr
  MISC_FEATURE (42)..(42): Xaa at position 42 is Gln or His
IIHQPXTXXGXXYILLQGSTXFHDRRRXXVXTXQAAXPLNXXYAYRLDTG

SEQ ID NO: 675 - protein, 50 aa, artificial sequence
  amino acid sequence motif
  MISC_FEATURE (2)..(2): Xaa at position 2 is His or Gln
  MISC_FEATURE (12)..(12): Xaa at position 12 is Ala or Val
  MISC_FEATURE (13)..(13): Xaa at position 13 is Asp or Asn
  MISC_FEATURE (17)..(17): Xaa at position 17 is His, Tyr or Phe
  MISC_FEATURE (23)..(23): Xaa at position 23 is His or Gln
  MISC_FEATURE (30)..(30): Xaa at position 30 is Arg or Ser
  MISC_FEATURE (31)..(31): Xaa at position 31 is Met or Ile
  MISC_FEATURE (33)..(33): Xaa at position 33 is Ile or Leu
  MISC_FEATURE (38)..(38): Xaa at position 38 is Met or Ile
  MISC_FEATURE (39)..(39): Xaa at position 39 is Leu or Met
  MISC_FEATURE (47)..(47): Xaa at position 47 is Met or Arg
SXADRLAAIQPXXLTNXLEMATXMDMRTTXXLXGLLNXXRIQNAALXYEY

SEQ ID NO: 676 - protein, 45 aa, artificial sequence
  amino acid sequence motif
  MISC_FEATURE (1)..(1): Xaa at position 1 is Val or Leu
  MISC_FEATURE (3)..(3): Xaa at position 3 is Arg or Gln
  MISC_FEATURE (21)..(21): Xaa at position 21 is Ser or Ala
  MISC_FEATURE (24)..(24): Xaa at position 24 is Asn or Asp
  MISC_FEATURE (26)..(26): Xaa at position 26 is Gly or Ala
  MISC_FEATURE (27)..(27): Xaa at position 27 is Glu or Gln
  MISC_FEATURE (29)..(29): Xaa at position 29 is Pro or Glu
  MISC_FEATURE (32)..(32): Xaa at position 32 is Glu or Gly
  MISC_FEATURE (33)..(33): Xaa at position 33 is Arg or Lys
  MISC_FEATURE (37)..(37): Xaa at position 37 is Val or Leu
  MISC_FEATURE (40)..(40): Xaa at position 38 is Phe or Leu
XDXVEFSEVMVIHRMYVNRLXDLXVXXLXGAXXVKRXYVXADVVE

SEQ ID NO: 677 - protein, 50 aa, artificial sequence
  amino acid sequence motif
  MISC_FEATURE (2)..(2): Xaa at position 2 is Asp or Glu
  MISC_FEATURE (12)..(12): Xaa at position 12 is Ser or Ala
  MISC_FEATURE (18)..(18): Xaa at position 18 is Arg or Lys
  MISC_FEATURE (20)..(20): Xaa at position 20 is Gln, Gly or Glu
  MISC_FEATURE (23)..(23): Xaa at position 23 is Asn or Asp
  MISC_FEATURE (24)..(24): Xaa at position 24 is Thr or Asp
  MISC_FEATURE (25)..(25): Xaa at position 25 is Ala or Thr
  MISC_FEATURE (26)..(26): Xaa at position 26 is Ile or Phe
  MISC_FEATURE (30)..(30): Xaa at position 30 is Asp or Glu
  MISC_FEATURE (32)..(32): Xaa at position 32 is Leu or Met
  MISC_FEATURE (40)..(40): Xaa at position 40 is Asn, Ser or Asp
  MISC_FEATURE (41)..(41): Xaa at position 41 is Arg or Gly
  MISC_FEATURE (47)..(47): Xaa at position 47 is Gln or Arg
AXRELQMESFHXAVISQXRXELXXXXAKMXRXSLQMEEEXXAMEQAXKEM

SEQ ID NO: 678 - protein, 50 aa, artificial sequence
  amino acid sequence motif
  MISC_FEATURE (2)..(2): Xaa at position 2 is Val or Leu
  MISC_FEATURE (12)..(12): Xaa at position 12 is Ala or Val
  MISC_FEATURE (20)..(20): Xaa at position 20 is Ser or Asn
  MISC_FEATURE (28)..(28): Xaa at position 28 is Ala or Gly
  MISC_FEATURE (38)..(38): Xaa at position 38 is Gly or Gln
  MISC_FEATURE (49)..(49): Xaa at position 49 is Val or Ile
FXTAGATAPGAXASAGQAVXIAGQAAQXLRRVVEILEXLEAVMEVVAAXK

SEQ ID NO: 679 - protein, 50 aa, artificial sequence
  amino acid sequence motif
  MISC_FEATURE (2)..(2): Xaa at position 2 is Gly or Asp
  MISC_FEATURE (3)..(3): Xaa at position 3 is Met or Ala
  MISC_FEATURE (4)..(4): Xaa at position 4 is Asn or Lys
  MISC_FEATURE (7)..(7): Xaa at position 7 is Ile or Thr
  MISC_FEATURE (9)..(9): Xaa at position 9 is Ile or Val
  MISC_FEATURE (10)..(10): Xaa at position 10 is Tyr or His
  MISC_FEATURE (11)..(11): Xaa at position 11 is Gly or Ala
  MISC_FEATURE (13)..(13): Xaa at position 13 is Lys or Glu
  MISC_FEATURE (15)..(15): Xaa at position 15 is Glu or Gln
  MISC_FEATURE (16)..(16): Xaa at position 16 is Arg, Val or Leu
  MISC_FEATURE (20)..(20): Xaa at position 20 is Leu, Tyr or Phe
  MISC_FEATURE (21)..(21): Xaa at position 21 is Pro or Asn
  MISC_FEATURE (22)..(22): Xaa at position 22 is Ser, Asn or Gly
  MISC_FEATURE (23)..(23): Xaa at position 23 is Asn or Trp
  MISC_FEATURE (24)..(24): Xaa at position 24 is Ala, Ser or Pro
  MISC_FEATURE (25)..(25): Xaa at position 25 is Ile or Tyr
  MISC_FEATURE (27)..(27): Xaa at position 27 is Ala, Gly or Val
  MISC_FEATURE (29)..(29): Xaa at position 29 is Trp or Glu
  MISC_FEATURE (31)..(31): Xaa at position 31 is Asp or Gln
  MISC_FEATURE (33)..(33): Xaa at position 33 is Cys or Ser
  MISC_FEATURE (34)..(34): Xaa at position 34 is Thr or Ile
  MISC_FEATURE (37)..(37): Xaa at position 37 is Ser or Ala
  MISC_FEATURE (39)..(39): Xaa at position 39 is Arg, Phe or Met
  MISC_FEATURE (42)..(42): Xaa at position 42 is His, Val or Thr
  MISC_FEATURE (43)..(43): Xaa at position 43 is Val or Phe
  MISC_FEATURE (44)..(44): Xaa at position 44 is Asn or Asp
  MISC_FEATURE (45)..(45): Xaa at position 45 is Ala, Glu or Arg
  MISC_FEATURE (48)..(48): Xaa at position 48 is Arg or Trp
  MISC_FEATURE (49)..(49): Xaa at position 49 is Ile or Val
  MISC_FEATURE (50)..(50): Xaa at position 50 is Ile or Arg
DXXXWGXYXXXEXVXXSPLXXXXXXLXVXAXRXXITXAXHNXXXXPGXXX

SEQ ID NO: 680 - protein, 50 aa, artificial sequence
  amino acid sequence motif
  MISC_FEATURE (1)..(1): Xaa at position 1 is Lys or Val
  MISC_FEATURE (2)..(2): Xaa at position 2 is Val or Lys
  MISC_FEATURE (3)..(3): Xaa at position 3 is Cys or Ala
  MISC_FEATURE (4)..(4): Xaa at position 4 is Arg, Gly or Cys
  MISC_FEATURE (5)..(5): Xaa at position 5 is Pro, His or Tyr
  MISC_FEATURE (9)..(9): Xaa at position 9 is Asp or Glu
  MISC_FEATURE (10)..(10): Xaa at position 10 is Met, Ile or Leu
  MISC_FEATURE (11)..(11): Xaa at position 11 is Met or Val
  MISC_FEATURE (15)..(15): Xaa at position 15 is Ala or Gly
  MISC_FEATURE (16)..(16): Xaa at position 16 is Glu or Val
  MISC_FEATURE (19)..(19): Xaa at position 19 is Leu, Ile or Asn
  MISC_FEATURE (22)..(22): Xaa at position 22 is Asn or Ser
  MISC_FEATURE (23)..(23): Xaa at position 23 is Asp or Lys
  MISC_FEATURE (27)..(27): Xaa at position 27 is Gln or Arg
  MISC_FEATURE (31)..(31): Xaa at position 31 is Lys or Asn
  MISC_FEATURE (34)..(34): Xaa at position 34 is Gln or His
  MISC_FEATURE (35)..(35): Xaa at position 35 is Leu or Met
  MISC_FEATURE (39)..(39): Xaa at position 39 is Ala or Glu
  MISC_FEATURE (40)..(40): Xaa at position 40 is Pro, Ser or Ala
XXXXXPSPXXXSAVXXHAXWLXXVLLXVVQXESXXQGTXXYNECLALLGR

SEQ ID NO: 681 - protein, 36 aa, artificial sequence
  amino acid sequence motif
  MISC_FEATURE (1)..(1): Xaa at position 1 is Pro or Asn
  MISC_FEATURE (3)..(3): Xaa at position 3 is Glu or Gln
  MISC_FEATURE (6)..(6): Xaa at position 6 is Val, Ala or Thr
  MISC_FEATURE (10)..(10): Xaa at position 10 is Gly or Arg
  MISC_FEATURE (15)..(15): Xaa at position 15 is Ala or Gly
  MISC_FEATURE (16)..(16): Xaa at position 16 is Asn or Asp
  MISC_FEATURE (20)..(20): Xaa at position 20 is Ala or Thr
  MISC_FEATURE (21)..(21): Xaa at position 21 is Gln or His
  MISC_FEATURE (23)..(23): Xaa at position 23 is Asn or Ser
  MISC_FEATURE (27)..(27): Xaa at position 27 is Val, Leu or Ser
  MISC_FEATURE (30)..(30): Xaa at position 30 is Thr or Trp
  MISC_FEATURE (34)..(34): Xaa at position 34 is Pro or Gln
  MISC_FEATURE (35)..(35): Xaa at position 35 is Ser or Pro
XTXLTXWPLXMDTVXXLLIXXEXAALXGLXQLGXXS

SEQ ID NO: 682 - protein, 30 aa, artificial sequence
  amino acid sequence motif
  MISC_FEATURE (1)..(1): Xaa at position 1 is Arg, Leu or Cys
  MISC_FEATURE (2)..(2): Xaa at position 2 is Asp, Leu, Trp or Lys
  MISC_FEATURE (3)..(3): Xaa at position 3 is Gln, Asn, Pro or Arg
  MISC_FEATURE (4)..(4): Xaa at position 4 is Met, Thr or Pro
  MISC_FEATURE (5)..(5): Xaa at position 5 is His, Gln or Arg
  MISC_FEATURE (6)..(6): Xaa at position 6 is Met, Ile or Leu
  MISC_FEATURE (14)..(14): Xaa at position 14 is Ile or Val
  MISC_FEATURE (23)..(23): Xaa at position 23 is Ile or Thr
  MISC_FEATURE (24)..(24): Xaa at position 24 is Asp or Gly
  MISC_FEATURE (26)..(26): Xaa at position 26 is Ser or Arg
  MISC_FEATURE (27)..(27): Xaa at position 27 is Gln, Phe or Arg
  MISC_FEATURE (28)..(28): Xaa at position 28 is Ala or Ser
  MISC_FEATURE (29)..(29): Xaa at position 29 is Thr, Ala or Asp
  MISC_FEATURE (30)..(30): Xaa at position 30 is Thr or Trp
XXXXXXPGSVTVIXLCRLLQFPXXGXXXXX

SEQ ID NO: 683 - protein, 26 aa, artificial sequence
  amino acid sequence motif
  MISC_FEATURE (1)..(1): Xaa at position 1 is Thr or Ala
  MISC_FEATURE (2)..(2): Xaa at position 2 is Ser, Gly or Val
  MISC_FEATURE (3)..(3): Xaa at position 3 is Ile or Leu
  MISC_FEATURE (6)..(6): Xaa at position 6 is Glu or Asp
  MISC_FEATURE (12)..(12): Xaa at position 12 is Ser or Asn
  MISC_FEATURE (15)..(15): Xaa at position 15 is Leu or Met
  MISC_FEATURE (20)..(20): Xaa at position 20 is Thr or Ser
  MISC_FEATURE (22)..(22): Xaa at position 22 is Leu or His
XXXPVXVVTDPXILXGMQTXVXIAEL

SEQ ID NO: 684 - protein, 26 aa, artificial sequence
  amino acid sequence motif
  MISC_FEATURE (5)..(5): Xaa at position 5 is Glu or Gln
  MISC_FEATURE (9)..(9): Xaa at position 9 is Arg or Glu
  MISC_FEATURE (13)..(13): Xaa at position 13 is Arg or Asn
  MISC_FEATURE (15)..(15): Xaa at position 15 is Val or Leu
  MISC_FEATURE (20)..(20): Xaa at position 20 is Lys or Ser
  MISC_FEATURE (21)..(21): Xaa at position 21 is Ala or Ser
  MISC_FEATURE (24)..(24): Xaa at position 24 is Met or Gln
  MISC_FEATURE (26)..(26): Xaa at position 26 is Ala or Gly
EGLRXFQNXQVAXAXFAVLXXVAXIX

SEQ ID NO: 685 - protein, 19 aa, artificial sequence
  amino acid sequence motif
  MISC_FEATURE (2)..(2): Xaa at position 2 is Thr or Ser
  MISC_FEATURE (12)..(12): Xaa at position 12 is Gln or His
  MISC_FEATURE (14)..(14): Xaa at position 14 is Ala or Val
  MISC_FEATURE (15)..(15): Xaa at position 15 is Gln or Lys
  MISC_FEATURE (17)..(17): Xaa at position 17 is Ala or Ser
  MISC_FEATURE (18)..(18): Xaa at position 18 is Ser or Met
  MISC_FEATURE (19)..(19): Xaa at position 19 is Gly or Asn
WXRVRIRHLEMXFXXEXXX

SEQ ID NO: 686 - protein, 19 aa, artificial sequence
  amino acid sequence motif
  MISC_FEATURE (2)..(2): Xaa at position 2 is Ile or Met
  MISC_FEATURE (4)..(4): Xaa at position 4 is Glu or Gln
  MISC_FEATURE (8)..(8): Xaa at position 8 is Glu or Asp
  MISC_FEATURE (14)..(14): Xaa at position 14 is Leu or Met
  MISC_FEATURE (15)..(15): Xaa at position 15 is Met or Ile
  MISC_FEATURE (18)..(18): Xaa at position 18 is Ile or Met
QXSXLQYXIWVQGXXRDXA

SEQ ID NO: 687 - protein, 14 aa, artificial sequence
  amino acid sequence motif
  MISC_FEATURE (1)..(1): Xaa at position 1 is Met, Leu or Val
  MISC_FEATURE (4)..(4): Xaa at position 4 is Ser or Lys
  MISC_FEATURE (5)..(5): Xaa at position 5 is Thr, Ser or Lys
  MISC_FEATURE (7)..(7): Xaa at position 7 is Tyr or Phe
  MISC_FEATURE (8)..(8): Xaa at position 8 is Arg or Glu
XDYXXLXXDLNQIS

SEQ ID NO: 688 - protein, 19 aa, artificial sequence
  amino acid sequence motif
  MISC_FEATURE (2)..(2): Xaa at position 2 is Arg, His or Gln
  MISC_FEATURE (4)..(4): Xaa at position 4 is Pro or Thr
  MISC_FEATURE (7)..(7): Xaa at position 7 is Gln or Lys
  MISC_FEATURE (11)..(11): Xaa at position 11 is Arg, Ile or Thr
  MISC_FEATURE (12)..(12): Xaa at position 12 is Val, Gln or Leu
  MISC_FEATURE (13)..(13): Xaa at position 13 is Ile or Arg
  MISC_FEATURE (15)..(15): Xaa at position 15 is Gln, Glu or Arg
  MISC_FEATURE (16)..(16): Xaa at position 16 is Asn or Phe
  MISC_FEATURE (17)..(17): Xaa at position 17 is Val or Arg
  MISC_FEATURE (18)..(18): Xaa at position 18 is Lys, Trp or Ser
  MISC_FEATURE (19)..(19): Xaa at position 19 is Ser or Glu
LXLXFMXLHAXXXEXXXXX

SEQ ID NO: 689 - protein, 14 aa, artificial sequence
  amino acid sequence motif
  MISC_FEATURE (2)..(2): Xaa at position 2 is Asp or Asn
  MISC_FEATURE (3)..(3): Xaa at position 3 is Ser or Ala
  MISC_FEATURE (5)..(5): Xaa at position 5 is Glu or Asp
  MISC_FEATURE (8)..(8): Xaa at position 8 is Gly or Ser
  MISC_FEATURE (9)..(9): Xaa at position 9 is Gln or His
  MISC_FEATURE (10)..(10): Xaa at position 10 is Ile or Leu
  MISC_FEATURE (12)..(12): Xaa at position 12 is Gly or Asp
VXXLXQVXXXVXAP

SEQ ID NO: 690 - protein, 14 aa, artificial sequence
  amino acid sequence motif
  MISC_FEATURE (1)..(1): Xaa at position 1 is Ile or Val
  MISC_FEATURE (2)..(2): Xaa at position 2 is Glu, Gln or His
  MISC_FEATURE (3)..(3): Xaa at position 3 is Cys, Ala or Ser
  MISC_FEATURE (4)..(4): Xaa at position 4 is Val or Ala
  MISC_FEATURE (5)..(5): Xaa at position 5 is Met or Ile
  MISC_FEATURE (7)..(7): Xaa at position 7 is Ile or Met
  MISC_FEATURE (8)..(8): Xaa at position 8 is Gly or Val
  MISC_FEATURE (9)..(9): Xaa at position 9 is Arg or Pro
  MISC_FEATURE (10)..(10): Xaa at position 10 is Phe or Ile
  MISC_FEATURE (11)..(11): Xaa at position 11 is Val or Gly
  MISC_FEATURE (12)..(12): Xaa at position 12 is Ser or Leu
XXXXXKXXXXXXVV

SEQ ID NO: 691 - protein, 10 aa, artificial sequence
  amino acid sequence motif
  MISC_FEATURE (5)..(5): Xaa at position 5 is Glu or Gln
  MISC_FEATURE (9)..(9): Xaa at position 9 is Glu, Gln, Asp or His
TLTNXPSEXF

SEQ ID NO: 692 - protein, 10 aa, artificial sequence
  amino acid sequence motif
  MISC_FEATURE (3)..(3): Xaa at position 3 is Arg or Ser
  MISC_FEATURE (6)..(6): Xaa at position 6 is Arg or Thr
  MISC_FEATURE (8)..(8): Xaa at position 8 is Ile or Val
LPXQSXNXSF

SEQ ID NO: 693 - protein, 50 aa, artificial sequence; identical to SEQ ID NO: 670
  amino acid sequence motif
  MISC_FEATURE (3)..(3): Xaa at position 3 is Asp or Glu
  MISC_FEATURE (6)..(6): Xaa at position 6 is Ser or Thr
  MISC_FEATURE (7)..(7): Xaa at position 7 is Glu or Asp
  MISC_FEATURE (17)..(17): Xaa at position 17 is Ile, Val or Leu
  MISC_FEATURE (33)..(33): Xaa at position 33 is Ala, Val, Ile or Leu
  MISC_FEATURE (35)..(35): Xaa at position 35 is Lys or Arg
  MISC_FEATURE (41)..(41): Xaa at position 41 is Met, Val, Ile or Leu
  MISC_FEATURE (49)..(49): Xaa at position 49 is Ser, Cys or Thr

SEQ ID NO: 694 - protein, 50 aa, artificial sequence; identical to SEQ ID NO: 671
  amino acid sequence motif
  MISC_FEATURE (10)..(10): Xaa at position 10 is Asn or Ser
  MISC_FEATURE (13)..(13): Xaa at position 13 is Lys, Arg, Asn or Gln
  MISC_FEATURE (24)..(24): Xaa at position 24 is Gln, Arg, Asn or Lys
  MISC_FEATURE (25)..(25): Xaa at position 25 is Glu or Asp
  MISC_FEATURE (28)..(28): Xaa at position 28 is Gln, Arg, Asn or Lys
  MISC_FEATURE (29)..(29): Xaa at position 29 is Phe or Leu
  MISC_FEATURE (30)..(30): Xaa at position 30 is Lys or Arg
  MISC_FEATURE (34)..(34): Xaa at position 34 is Ile, Ala, Val or Leu
  MISC_FEATURE (39)..(39): Xaa at position 39 is Leu, Phe Ile or Val
  MISC_FEATURE (45)..(45): Xaa at position 45 is Gln, Glu, Asn or Asp
  MISC_FEATURE (48)..(48): Xaa at position 48 is Lys or Arg

SEQ ID NO: 695 - protein, 50 aa, artificial sequence; identical to SEQ ID NO: 672
  amino acid sequence motif
  MISC_FEATURE (2)..(2): Xaa at position 2 is Thr, Lys, Ser or Arg
  MISC_FEATURE (11)..(11): Xaa at position 11 is Arg, His or Lys
  MISC_FEATURE (21)..(21): Xaa at position 21 is Ser, Pro, Lys, Ala, Thr or Arg
  MISC_FEATURE (24)..(24): Xaa at position 24 is Ala, Lys or Arg
  MISC_FEATURE (25)..(25): Xaa at position 25 is Glu or Gly
  MISC_FEATURE (34)..(34): Xaa at position 34 is Pro, Leu, Ile or Val
  MISC_FEATURE (39)..(39): Xaa at position 39 is Glu, Gln, Asn or Asp
  MISC_FEATURE (40)..(40): Xaa at position 40 is Ile, Val or Leu
  MISC_FEATURE (41)..(41): Xaa at position 41 is Val, Ala, Ile or Leu

SEQ ID NO: 696 - protein, 36 aa, artificial sequence; identical to SEQ ID NO: 673
  amino acid sequence motif
  MISC_FEATURE (1)..(1): Xaa at position 1 is Asp, Asn, Gln or Glu
  MISC_FEATURE (10)..(10): Xaa at position 10 is Gly, Asp or or Glu
  MISC_FEATURE (14)..(14): Xaa at position 14 is Ser, Asn, Thr or Gln
  MISC_FEATURE (20)..(20): Xaa at position 20 is Glu, Gly or Asp
  MISC_FEATURE (30)..(30): Xaa at position 30 is Ala or Gly

SEQ ID NO: 697 - protein, 50 aa, artificial sequence; identical to SEQ ID NO: 674
  amino acid sequence motif
  MISC_FEATURE (6)..(6): Xaa at position 6 is Ser, Ala or Thr
  MISC_FEATURE (8)..(8): Xaa at position 8 is Arg, Gln, Lys or Asn
  MISC_FEATURE (9)..(9): Xaa at position 9 is Ser or Thr
  MISC_FEATURE (11)..(11): Xaa at position 11 is Ile, Thr, Leu, Val or Ser
  MISC_FEATURE (12)..(12): Xaa at position 12 is Val, Ile or Leu
  MISC_FEATURE (21)..(21): Xaa at position 21 is Ile, Val or Leu
  MISC_FEATURE (28)..(28): Xaa at position 28 is Asp or Glu
  MISC_FEATURE (29)..(29): Xaa at position 29 is Glu, Gln, Asp or Asn
  MISC_FEATURE (31)..(31): Xaa at position 31 is Met, Leu, Ile or Val
  MISC_FEATURE (33)..(33): Xaa at position 33 is Phe or Pro
  MISC_FEATURE (37)..(37): Xaa at position 37 is Asp, Ala, Val, Glu, Ile or Leu
  MISC_FEATURE (41)..(41): Xaa at position 41 is Phe or Tyr
  MISC_FEATURE (42)..(42): Xaa at position 42 is Gln, His or Asn

SEQ ID NO: 698 - protein, 50 aa, artificial sequence; identical to SEQ ID NO: 675
  amino acid sequence motif
  MISC_FEATURE (2)..(2): Xaa at position 2 is His, Gln or Asn
  MISC_FEATURE (12)..(12): Xaa at position 12 is Ala, Val, Ile or Leu
  MISC_FEATURE (13)..(13): Xaa at position 13 is Asp or Asn
  MISC_FEATURE (17)..(17): Xaa at position 17 is His, Tyr or Phe
  MISC_FEATURE (23)..(23): Xaa at position 23 is His, Gln or Asn
  MISC_FEATURE (30)..(30): Xaa at position 30 is Arg, Ser, Lys or Thr
  MISC_FEATURE (31)..(31): Xaa at position 31 is Met, Ile, Leu or Val
  MISC_FEATURE (33)..(33): Xaa at position 33 is Ile, Leu or Val
  MISC_FEATURE (38)..(38): Xaa at position 38 is Met, Ile, Leu or Val
  MISC_FEATURE (39)..(39): Xaa at position 39 is Leu, Met, Ile or Val
  MISC_FEATURE (47)..(47): Xaa at position 47 is Met, Arg, Ile, Leu, Val or Lys

SEQ ID NO: 699 - protein, 45 aa, artificial sequence; identical to SEQ ID NO: 676
  amino acid sequence motif
  MISC_FEATURE (1)..(1): Xaa at position 1 is Val, Leu or Ile
  MISC_FEATURE (3)..(3): Xaa at position 3 is Arg, Gln, Lys or Asn
  MISC_FEATURE (21)..(21): Xaa at position 21 is Ser, Ala or Thr
  MISC_FEATURE (24)..(24): Xaa at position 24 is Asn, Asp, Gln or Glu
  MISC_FEATURE (26)..(26): Xaa at position 26 is Gly or Ala
  MISC_FEATURE (27)..(27): Xaa at position 27 is Glu, Gln, Asn or Asp
  MISC_FEATURE (29)..(29): Xaa at position 29 is Pro, Glu or Asp
  MISC_FEATURE (32)..(32): Xaa at position 32 is Glu, Gly or Asp
  MISC_FEATURE (33)..(33): Xaa at position 33 is Arg or Lys
  MISC_FEATURE (37)..(37): Xaa at position 37 is Val, Leu or Ile
  MISC_FEATURE (40)..(40): Xaa at position 40 is Phe, Leu, Ile or Val

SEQ ID NO: 700 - protein, 50 aa, artificial sequence; identical to SEQ ID NO: 677
  amino acid sequence motif
  MISC_FEATURE (2)..(2): Xaa at position 2 is Asp or Glu
  MISC_FEATURE (12)..(12): Xaa at position 12 is Ser, Ala or Thr
  MISC_FEATURE (18)..(18): Xaa at position 18 is Arg or Lys
  MISC_FEATURE (20)..(20): Xaa at position 20 is Gln, Gly, Glu, Asn or Asp
  MISC_FEATURE (23)..(23): Xaa at position 23 is Asn, Asp, Gln or Glu
  MISC_FEATURE (24)..(24): Xaa at position 24 is Thr, Asp, Ser or Glu
  MISC_FEATURE (25)..(25): Xaa at position 25 is Ala, Thr or Ser
  MISC_FEATURE (26)..(26): Xaa at position 26 is Ile, Phe, Leu or Val
  MISC_FEATURE (30)..(30): Xaa at position 30 is Asp or Glu
  MISC_FEATURE (32)..(32): Xaa at position 32 is Leu, Met, Ile or Val
  MISC_FEATURE (40)..(40): Xaa at position 40 is Asn, Ser, Asp, Gln, Glu or Thr
  MISC_FEATURE (41)..(41): Xaa at position 41 is Arg, Gly or Lys
  MISC_FEATURE (47)..(47): Xaa at position 47 is Gln, Arg, Asn or Lys

SEQ ID NO: 701 - protein, 50 aa, artificial sequence; identical to SEQ ID NO: 678
  amino acid sequence motif
  MISC_FEATURE (2)..(2): Xaa at position 2 is Val, Leu or Ile
  MISC_FEATURE (12)..(12): Xaa at position 12 is Ala, Val, Ile or Leu
  MISC_FEATURE (20)..(20): Xaa at position 20 is Ser, Asn, Thr or Gln
  MISC_FEATURE (28)..(28): Xaa at position 28 is Ala or Gly
  MISC_FEATURE (38)..(38): Xaa at position 38 is Gly, Gln or Asn
  MISC_FEATURE (49)..(49): Xaa at position 49 is Val, Ile or Leu

SEQ ID NO: 702 - protein, 50 aa, artificial sequence; identical to SEQ ID NO: 679
  amino acid sequence motif
  MISC_FEATURE (2)..(2): Xaa at position 2 is Gly, Asp or Glu
  MISC_FEATURE (3)..(3): Xaa at position 3 is Met or Ala
  MISC_FEATURE (4)..(4): Xaa at position 4 is Asn, Lys, Gln or Arg;
  MISC_FEATURE (7)..(7): Xaa at position 7 is Ile, Thr, Leu, Val or Ser
  MISC_FEATURE (9)..(9): Xaa at position 9 is Ile, Val or Leu
  MISC_FEATURE (10)..(10): Xaa at position 10 is Tyr or His
  MISC_FEATURE (11)..(11): Xaa at position 11 is Gly or Ala
  MISC_FEATURE (13)..(13): Xaa at position 13 is Lys, Glu, Arg or Asp
  MISC_FEATURE (15)..(15): Xaa at position 15 is Glu, Gln, Asp or Asn
  MISC_FEATURE (16)..(16): Xaa at position 16 is Arg, Val, Leu, Lys or Ile
  MISC_FEATURE (20)..(20): Xaa at position 20 is Leu, Tyr, Phe, Ile or Val
  MISC_FEATURE (21)..(21): Xaa at position 21 is Pro, Asn or Gln
  MISC_FEATURE (22)..(22): Xaa at position 22 is Ser, Asn, Gly, Thr or Gln
  MISC_FEATURE (23)..(23): Xaa at position 23 is Asn, Trp or Gln
  MISC_FEATURE (24)..(24): Xaa at position 24 is Ala, Ser, Pro or Thr
  MISC_FEATURE (25)..(25): Xaa at position 25 is Ile, Tyr, Leu or Val
  MISC_FEATURE (27)..(27): Xaa at position 27 is Ala, Gly, Val, Ile or Leu
  MISC_FEATURE (29)..(29): Xaa at position 29 is Trp, Glu or Asp
  MISC_FEATURE (31)..(31): Xaa at position 31 is Asp, Gln, Asn or Glu
  MISC_FEATURE (33)..(33): Xaa at position 33 is Cys, Ser or Thr
  MISC_FEATURE (34)..(34): Xaa at position 34 is Thr, Ile, Ser Leu or Val
  MISC_FEATURE (37)..(37): Xaa at position 37 is Ser, Ala, or Thr
  MISC_FEATURE (39)..(39): Xaa at position 39 is Arg, Phe, Met or Lys
  MISC_FEATURE (42)..(42): Xaa at position 42 is His, Val, Thr, Ile Leu or Ser
  MISC_FEATURE (43)..(43): Xaa at position 43 is Val, Phe, Ile or Leu
  MISC_FEATURE (44)..(44): Xaa at position 44 is Asn, Asp, Gln or Glu
  MISC_FEATURE (45)..(45): Xaa at position 45 is Ala, Glu, Arg, Asp or Lys
  MISC_FEATURE (48)..(48): Xaa at position 48 is Arg, Trp or Lys
  MISC_FEATURE (49)..(49): Xaa at position 49 is Ile, Val or Ile
  MISC_FEATURE (50)..(50): Xaa at position 50 is Ile, Arg, Leu, Val or Lys

SEQ ID NO: 703 - protein, 50 aa, artificial sequence; identical to SEQ ID NO: 680
  amino acid sequence motif
  MISC_FEATURE (1)..(1): Xaa at position 1 is Lys, Val, Arg, Ile or Leu
  MISC_FEATURE (2)..(2): Xaa at position 2 is Val, Lys, Arg, Ile or Leu
  MISC_FEATURE (3)..(3): Xaa at position 3 is Cys or Ala
  MISC_FEATURE (4)..(4): Xaa at position 4 is Arg, Gly, Cys or Lys
  MISC_FEATURE (5)..(5): Xaa at position 5 is Pro, His or Tyr
  MISC_FEATURE (9)..(9): Xaa at position 9 is Asp or Glu
  MISC_FEATURE (10)..(10): Xaa at position 9 is Asp or Glu
  MISC_FEATURE (11)..(11): Xaa at position 11 is Met, Val, Ile or Leu
  MISC_FEATURE (15)..(15): Xaa at position 15 is Ala or Gly
  MISC_FEATURE (16)..(16): Xaa at position 16 is Glu, Val, Asp, Ile or Leu
  MISC_FEATURE (19)..(19): Xaa at position 19 is Leu, Ile, Asn, Val or Gln
  MISC_FEATURE (22)..(22): Xaa at position 22 is Asn, Ser, Gln or Thr
  MISC_FEATURE (23)..(23): Xaa at position 23 is Asp, Lys, Glu or Arg
  MISC_FEATURE (27)..(27): Xaa at position 27 is Gln, Arg, Asn or Lys
  MISC_FEATURE (31)..(31): Xaa at position 31 is Lys, Asn, Arg or Gln
  MISC_FEATURE (34)..(34): Xaa at position 34 is Gln, His or Asn
  MISC_FEATURE (35)..(35): Xaa at position 35 is Leu, Met, Ile or Val
  MISC_FEATURE (39)..(39): Xaa at position 39 is Ala, Glu or Asp
  MISC_FEATURE (40)..(40): Xaa at position 40 is Pro, Ser, Ala or Thr

SEQ ID NO: 704 - protein, 36 aa, artificial sequence; identical to SEQ ID NO: 681
  amino acid sequence motif
  MISC_FEATURE (1)..(1): Xaa at position 1 is Pro, Asn or Gln
  MISC_FEATURE (3)..(3): Xaa at position 3 is Glu, Gln, Asp or Asn;
  MISC_FEATURE (6)..(6): Xaa at position 6 is Val, Ala, Thr, Ile, Leu or Ser
  MISC_FEATURE (10)..(10): Xaa at position 10 is Gly, Arg or Lys
  MISC_FEATURE (15)..(15): Xaa at position 15 is Ala or Gly
  MISC_FEATURE (16)..(16): Xaa at position 16 is Asn, Asp, Gln or Glu
  MISC_FEATURE (20)..(20): Xaa at position 20 is Ala, Thr or Ser
  MISC_FEATURE (21)..(21): Xaa at position 21 is Gln, His or Asn
  MISC_FEATURE (23)..(23): Xaa at position 23 is Asn, Ser, Gln or Thr
  MISC_FEATURE (27)..(27): Xaa at position 27 is Val, Leu, Ser, Ile or Thr
  MISC_FEATURE (30)..(30): Xaa at position 30 is Ile, Thr, Met, Ala, Leu, Val or Ser
  MISC_FEATURE (34)..(34): Xaa at position 34 is Pro, Gln or Asn
  MISC_FEATURE (35)..(35): Xaa at position 35 is Ser, Pro or Thr

SEQ ID NO: 705 - protein, 30 aa, artificial sequence; identical to SEQ ID NO: 682
  amino acid sequence motif
  MISC_FEATURE (1)..(1): Xaa at position 1 is Arg, Leu, Cys, Lys, Ile or Val
  MISC_FEATURE (2)..(2): Xaa at position 2 is Asp, Leu, Trp, Lys, Glu, Ile, Val or Arg
  MISC_FEATURE (3)..(3): Xaa at position 3 is Gln, Asn, Pro, Arg or Lys
  MISC_FEATURE (4)..(4): Xaa at position 4 is Met, Thr or Pro
  MISC_FEATURE (5)..(5): Xaa at position 5 is His, Gln or Arg
  MISC_FEATURE (6)..(6): Xaa at position 6 is Met, Ile, Leu or Val
  MISC_FEATURE (14)..(14): Xaa at position 14 is Ile, Val or Leu
  MISC_FEATURE (23)..(23): Xaa at position 23 is Ile, Thr, Leu, Val or Ser
  MISC_FEATURE (24)..(24): Xaa at position 24 is Asp, Gly or Glu
  MISC_FEATURE (26)..(26): Xaa at position 26 is Ser, Arg, Thr or Lys
  MISC_FEATURE (27)..(27): Xaa at position 27 is Gln, Phe, Arg, Asn or Lys
  MISC_FEATURE (28)..(28): Xaa at position 28 is Ala, Ser or Thr
  MISC_FEATURE (29)..(29): Xaa at position 29 is Thr, Ala, Asp, Glu or Ser
  MISC_FEATURE (30)..(30): Xaa at position 30 is Thr, Trp or Ser

SEQ ID NO: 706 - protein, 26 aa, artificial sequence
  amino acid sequence motif
  MISC_FEATURE (1)..(1): Xaa at position 1 is Thr or Ala
  MISC_FEATURE (2)..(2): Xaa at position 2 is Ser, Gly, Val, Thr, Ile or Leu
  MISC_FEATURE (3)..(3): Xaa at position 3 is Ile, Leu or Val
  MISC_FEATURE (6)..(6): Xaa at position 6 is Glu or Asp
  MISC_FEATURE (12)..(12): Xaa at position 12 is Ser, Asn, Thr or Gln
  MISC_FEATURE (15)..(15): Xaa at position 15 is Leu, Met, Ile or Val
  MISC_FEATURE (20)..(20): Xaa at position 20 is Thr or Ser
  MISC_FEATURE (22)..(22): Xaa at position 22 is Leu, His, Ile or Val
XXXPVXVVTDPXILXGMQTXVXIAEL

SEQ ID NO: 707 - protein, 26 aa, artificial sequence
  amino acid sequence motif
  MISC_FEATURE (5)..(5): Xaa at position 5 is Glu, Gln, Asn or Asp
  MISC_FEATURE (9)..(9): Xaa at position 9 is Arg, Glu, Lys or Asp
  MISC_FEATURE (13)..(13): Xaa at position 13 is Arg, Asn, Lys or Gln
  MISC_FEATURE (15)..(15): Xaa at position 15 is Val, Leu or Ile
  MISC_FEATURE (20)..(20): Xaa at position 20 is Lys, Ser, Arg or Thr
  MISC_FEATURE (21)..(21): Xaa at position 21 is Ala, Ser or Thr
  MISC_FEATURE (24)..(24): Xaa at position 24 is Met, Gln or Asn
  MISC_FEATURE (26)..(26): Xaa at position 26 is Ala or Gly
EGLRXFQNXQVAXAXFAVLXXVAXIX

SEQ ID NO: 708 - protein, 19 aa, artificial sequence
  amino acid sequence motif
  MISC_FEATURE (2)..(2): Xaa at position 2 is Thr or Ser
  MISC_FEATURE (12)..(12): Xaa at position 12 is Gln, His or Asn
  MISC_FEATURE (14)..(14): Xaa at position 14 is Ala, Val, Ile or Leu
  MISC_FEATURE (15)..(15): Xaa at position 15 is Gln, Lys, Asn or Arg
  MISC_FEATURE (17)..(17): Xaa at position 17 is Ala, Ser or Thr
  MISC_FEATURE (18)..(18): Xaa at position 18 is Ser, Met or Thr
  MISC_FEATURE (19)..(19): Xaa at position 19 is Gly, Asn or Gln
WXRVRIRHLEMXFXXEXXX

SEQ ID NO: 709 - protein, 19 aa, artificial sequence
  amino acid sequence motif
  MISC_FEATURE (2)..(2): Xaa at position 2 is Ile, Met, Leu or Val
  MISC_FEATURE (4)..(4): Xaa at position 4 is Glu, Gln, Asn or Asp
  MISC_FEATURE (8)..(8): Xaa at position 8 is Glu or Asp
  MISC_FEATURE (14)..(14): Xaa at position 14 is Leu, Met, Ile or Val
  MISC_FEATURE (15)..(15): Xaa at position 15 is Met, Ile, Leu or Val
  MISC_FEATURE (18)..(18): Xaa at position 18 is Ile, Met, Ile or Val
QXSXLQYXIWVQGXXRDXA

SEQ ID NO: 710 - protein, 14 aa, artificial sequence
  amino acid sequence motif
  MISC_FEATURE (1)..(1): Xaa at position 1 is Met, Leu, Val or Ile
  MISC_FEATURE (4)..(4): Xaa at position 4 is Ser, Lys, Thr or Arg
  MISC_FEATURE (5)..(5): Xaa at position 5 is Thr, Ser, Lys or Arg
  MISC_FEATURE (7)..(7): Xaa at position 7 is Tyr or Phe
  MISC_FEATURE (8)..(8): Xaa at position 8 is Arg, Glu, Lys or Asp
XDYXXLXXDLNQIS

SEQ ID NO: 711 - protein, 19 aa, artificial sequence
  amino acid sequence motif
  MISC_FEATURE (2)..(2): Xaa at position 2 is Arg, His, Gln, Lys or Asn
  MISC_FEATURE (4)..(4): Xaa at position 4 is Pro, Thr or Ser
  MISC_FEATURE (7)..(7): Xaa at position 7 is Gln, Lys, Asn or Arg
  MISC_FEATURE (11)..(11): Xaa at position 11 is Arg, Ile, Thr, Lys, Leu, Val or Ser
  MISC_FEATURE (12)..(12): Xaa at position 12 is Val, Gln, Leu, Ile or Asn
  MISC_FEATURE (13)..(13): Xaa at position 13 is Ile, Arg, Leu, Val or Lys
  MISC_FEATURE (15)..(15): Xaa at position 15 is Gln, Glu, Arg, Asn, Asp or Lys
  MISC_FEATURE (16)..(16): Xaa at position 16 is Asn, Phe or Gln
  MISC_FEATURE (17)..(17): Xaa at position 17 is Val, Arg, Ile, Leu or Lys
  MISC_FEATURE (18)..(18): Xaa at position 18 is Lys, Trp, Ser, Arg or Thr
  MISC_FEATURE (19)..(19): Xaa at position 19 is Ser, Glu, Thr or Asp
LXLXFMXLHAXXXEXXXXX

SEQ ID NO: 712 - protein, 14 aa, artificial sequence
  amino acid sequence motif
  MISC_FEATURE (2)..(2): Xaa at position 2 is Asp, Asn, Gln or Glu
  MISC_FEATURE (3)..(3): Xaa at position 3 is Ser, Ala or Thr
  MISC_FEATURE (5)..(5): Xaa at position 5 is Glu or Asp
  MISC_FEATURE (8)..(8): Xaa at position 8 is Gly, Ser or Thr
  MISC_FEATURE (9)..(9): Xaa at position 9 is Gln, His or Asn
  MISC_FEATURE (10)..(10): Xaa at position 10 is Ile, Leu or Val
  MISC_FEATURE (12)..(12): Xaa at position 12 is Gly, Asp or Glu
VXXLXQVXXXVXAP

SEQ ID NO: 713 - protein, 14 aa, artificial sequence
  amino acid sequence motif
  MISC_FEATURE (1)..(1): Xaa at position 1 is Ile, Val or Ile
  MISC_FEATURE (2)..(2): Xaa at position 2 is Glu, Gln, His, Asn or Asp
  MISC_FEATURE (3)..(3): Xaa at position 3 is Cys, Ala, Ser or Thr
  MISC_FEATURE (4)..(4): Xaa at position 4 is Val, Ala, Ile or Leu
  MISC_FEATURE (5)..(5): Xaa at position 5 is Met, Ile, Leu or Val
  MISC_FEATURE (7)..(7): Xaa at position 7 is Ile, Met, Leu or Val
  MISC_FEATURE (8)..(8): Xaa at position 8 is Gly, Val, Ile or Val
  MISC_FEATURE (9)..(9): Xaa at position 9 is Arg, Pro or Lys
  MISC_FEATURE (10)..(10): Xaa at position 10 is Phe, Ile, Leu or Val
  MISC_FEATURE (11)..(11): Xaa at position 11 is Val, Gly, Ile or Val
  MISC_FEATURE (12)..(12): Xaa at position 12 is Ser, Leu, Thr, Ile or Val
XXXXXKXXXXXXVV

SEQ ID NO: 714 - protein, 10 aa, artificial sequence
  amino acid sequence motif
  MISC_FEATURE (5)..(5): Xaa at position 5 is Glu, Gln, Asp or Asn
  MISC_FEATURE (9)..(9): Xaa at position 9 is Glu, Gln, Asp, His or Asn
TLTNXPSEXF

SEQ ID NO: 715 - protein, 10 aa, artificial sequence
  amino acid sequence motif
  MISC_FEATURE (3)..(3): Xaa at position 3 is Arg, Ser, Lys or Thr
  MISC_FEATURE (6)..(6): Xaa at position 6 is Arg, Thr, Lys or Ser
  MISC_FEATURE (8)..(8): Xaa at position 8 is Ile, Val or Ile
LPXQSXNXSF

SEQ ID NO: 716 - protein, 886 aa, Polypodium punctatum
MEYSSLYGDVNQVSLRFQNMEFSEVMVVHRMHVRLEELDMTGLEGIEKVKRLYVLADVVELPSTATQVFQYLRLPASISAIILCRVLYIPEVDQRPHMAQCSLDFPFMRLHVVGSAHENGGGVMQAFSSDATPSNIGIYFHADRFIYRQATSSASNFVLPLDVRVSFGSSTFSAPTLRPDWQNLNVSNIQYGPQHLSRGPPLTSSDSDLQRSDEIELLAQQDVWSPLLHVAFSPNAPPGNIPGTQGIFRPSSACSFFHVPPPDVPANVLTDPSIILGMQMNMLIAELVLAAHNSPQVMNVITKHVLWLNKILLQVASPNDDILALLFRIQAFMKMAKEPRFVVPRLQYHMYGSLINRMVQVAQNYDQEFKQLKLFIAQNKILGSYLLQQNRAFAEREREMSAFHSQVVSMRRSELQSAIQTMDNLSLQMESESEAMNEAQENMVEAIQEYERKLLARALFSVIGAIASVALAFATGGATAPGAVAAAGGAVAAAGRLAAGLQKVVDILQGLQAVMEVVVAIRDIVESLKNMGQLVEAPEMPEMPTDADWLIFVNEVEAVAEQVPTEVAEVPVWKAKCKNVAVLGQAMCTTAAYISELQYQITVEEMLQEIAQRQADRLVGISAADLSSYTEMASQIDMRTTRILLELIKMLYIQNAAIKYEYLYDANEKLNSWPVSMETVWTMLLQQENAALLGLLDLGPTNDFTVTYAVKDIPTKLLVDGFDWNFEIAVEDFAIFPSGLSRVRIRYVELKFDQQGADSSNIVIHQPSTNTGLVYMLLQGSRFVHDRKRQEVMDYEASTGPVYAYAYDLNTGATTLNNIPSQQQANTFMQMTPFNAWRLRLSASAAENQGLVFPTATSPDNTTQISITFYVTAIRRIDLRQEGDVE

SEQ ID NO: 717 - DNA, 2658 bp, Polypodium punctatum
atggagtatagcagcttgtatggtgatgtgaaccaagtgagcctgaggttccagaacatggagttctctgaggtcatggtggtgcatcggatgcatgtgcgcctggaggagcttgacatgacggggttggagggcatcgagaaggtgaaacgcctgtacgtgctggcggacgtggtggagctgccttccacagccacccaggtgtttcagtatctgcgccttcccgcctccatttcagctattatcctctgccgcgttctctatatccctgaagttgatcagaggccccacatggctcaatgctcgctcgacttcccgtttatgcgcctccatgtcgtcggatctgcacacgagaacggtgggggtgttatgcaagccttttcctccgacgccacccccagcaatattggcatctacttccatgctgaccgattcatctaccgccaggccacatcttcggccagcaactttgtcttgcccctggatgtaagggtcagctttggcagctctaccttctcggccccaaccctccgtcccgactggcaaaaccttaatgtctccaacatccagtacgggccgcagcatttgtccaggggcccacccctcacatcctcagactctgacttgcaaagatctgacgagatcgagctcctggcgcagcaagatgtttggagccctcttttacatgtcgcgttcagcccgaatgcaccacctggcaacatcccgggtacacaaggaattttccgaccctcctctgcatgcagctttttccatgtgccgccaccggatgtccctgcgaatgtgctcactgatccttccatcatcttgggcatgcaaatgaacatgctcattgctgagcttgtcttggctgctcacaattcgccgcaggtcatgaacgtcatcactaagcatgtgctatggctcaacaagatcttgcttcaggttgcttcacccaatgatgatattttagcactcttgtttcgtatccaagcattcatgaagatggcaaaggaaccgcggtttgtggttccacggttgcagtaccacatgtacggtagccttatcaatcgaatggtgcaagtagcccagaattatgaccaggagttcaagcaactgaagcttttcatcgcacaaaataagattttgggaagctatttgctacaacaaaatagggcttttgcagaaagggagagggaaatgagtgcttttcactcgcaagtcgtatcgatgaggagatctgagctgcagtctgccatacaaacaatggacaatttgagtttgcaaatggaatcagagagtgaggcgatgaacgaagcccaggagaacatggttgaagcaattcaagagtatgaaaggaaattacttgcaagagctctattttctgtgattggggcaatagcaagcgtcgctcttgcatttgccactggtggtgcaactgcaccaggggcagtggcagcagctggaggggctgttgctgcagcagggaggttggcagcagggctccaaaaggttgtggacatcctacaaggcttgcaagcagtcatggaggttgtggtagccataagagacatcgtagaatcattgaaaaacatgggtcaactagtagaagctcccgagatgccagagatgccaacggatgcggactggttaatttttgtaaatgaggtggaggcagtggcagagcaagtgccaacagaagtggcagaggtcccagtgtggaaggcgaagtgcaagaatgtggctgtgctagggcaagcaatgtgcaccacagcagcatatattagtgagctacagtatcagatcacggtggaagagatgctacaagagattgcacaacgccaagcagacaggttggtggggatatcagcagcagatctatcgagctacacagagatggcatcgcaaatagacatgcgtacaacccgaatcctccttgagctcatcaagatgttgtacattcaaaatgcagcaattaagtatgagtacttgtatgatgctaatgagaagcttaattcatggccagtgagcatggagactgtatggaccatgctcttgcaacaagagaatgcagctctcttgggcttgctagacttggggcccaccaatgatttcactgtaacctatgctgtgaaagatatacctaccaagttgttagtagatgggtttgattggaattttgagatcgcggtggaggattttgcaatctttccatcaggattgtctcgtgttcgcatacgatatgttgagcttaaatttgaccaacaaggtgctgatagtagtaacattgtcatccaccagcctagcactaacactggcttagtctacatgctcttacaaggctcccggttcgtccatgaccgcaaacgtcaggaggtgatggactatgaggcaagcacgggacctgtatatgcatatgcctatgacctcaacactggtgcaaccactctcaacaacatcccctcacagcaacaggccaacacatttatgcaaatgacacccttcaatgcttggagacttcgcctctctgcctctgctgccgaaaatcagggattggtgtttcctacagcaacttctccggacaatactacccaaatttccatcacattctatgtcactgctattcgacgcatagatcttcgacaagagggtgatgtggag

SEQ ID NO: 718 - DNA, 2598 bp, Artificial Sequence
  encodes PtIP-83 polypeptide variant
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 719 - DNA, 2598 bp, Artificial Sequence
  encodes PtIP-83 polypeptide variant
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcatgctgcgatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 720 - DNA, 2563 bp, Artificial Sequence
  encodes PtIP-83 polypeptide variant
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgttggcagacgtggtggagctcgcaacatttgcgcatccacagttgcttaatacgcggatgccaggatcggtgacggtgatcattctgtgtcgtcttcttcagtttccaactgatgggtcgttcgctgcttggctcgagctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagagtagc

SEQ ID NO: 721 - DNA, 2601 bp, Artificial Sequence
  encodes PtIP-83 polypeptide variant
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 722 - DNA, 2550 bp, Artificial Sequence
  encodes PtIP-83 polypeptide variant
atggattacagcacgctttacagggatctgaaccagataagcatgcccctggatcgggtagagttctcagaggtgatggtaatccacaggatgtacttgaggttatctgatctgaatgtggggcagctcgagggagccgagagggtgaagcggttgtatgtgtttgcggacgtggtggagctaccagtcgtggaatggcggtggccgccgcaaataccaggatcggtgacggtgatcatattgtgtcgtcttcttcagtttccaactgatgggtcgttcgctgcttggctcgggctgccgttcatggagttgcacacactcatagaacaatacaggtcagagataaaagcagcagatgacgcgaaatggggaacgtatgtacacgcggaggaagtacagctcagcccgctgtttaatgggtggccttatctggttgttgaggcacagcgctgtattataaccgcggccatgcacaatacatttaaccgccctgggtgggttcgctccattactcaatttacaactgatcagtccggtcgggtagataccacactgctcgcacgaacagaattcggccatattgatctaccactcgaaacagattccccaacggcattcagtgtttcacaccgccaaagtacgaatttgcccgtagagtacaccggtattccagtggaggtggtgaccgatcctaacatcttgatgggcatgcaaaccagcgtgcacattgcggagctagtgaaggcatgttacccgtcaccagaattagtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 723 - DNA, 2589 bp, Artificial Sequence
  encodes PtIP-83 polypeptide variant
atggattacagcacgctttacagggatctgaaccagataagcatgcccctggatcgggtagagttctcagaggtgatggtaatccacaggatgtacttgaggttatctgatctgaatgtgggggagctccccggagccgagagggtgaagcggttgtatgtgtttgcggacgtggtggagctaccagtcgtggaatggcggtggccgccgcaaataccaggatcggtgacggtgatcattctgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgaccgatcctaacatcttgatgggcatgcaaaccagcgtgcacattgcggagctagtcaaggcatgtcatccgtcacccgatgttgtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtatggtagcctcatcagacaaatggcccaggtagcacagaactacgaccaagatttcaggcagctcaagttattcattgcccaaaaccaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 724 - DNA, 2608 bp, Artificial Sequence
  encodes PtIP-83 polypeptide variant
atggctctcgtggattacggcaagcttttcgaggatctgaaccagataagcatgggtgtactggatcgggtagagttttcagaggtgatggtgatccacaggatgtatgtgaggctagctgatctgaatgtggggcagctcgagggagccgagaaagtgaagcggttgtatgtgtttgcagacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtgaaggcatgtcatccgtcacccgatgttgtgagcgctgtaggggtgcacgtgaattggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtacggtagcctcatcaaccaaatggcccaagtagcacaaaactacgaccgagaattcaagcaattcaaattattcatcatccaaaatcaaatccttggcagctatttgctgcagcagaacagggcatttgctgagagggagctgcagatggagagctttcatgctgctgtcatttctcaaagaagggaggagttggacaatacattcgcaaagatggaccgattgagcgggcaaatggaggcagagagtagtgcaatggagcaagccaaaaaggaaatggacgaaggattgaggcagttccagaataggcaagttgcgaacgccctctttgccgttcttagcgctgtagctcagattgggcttgcattccttacggctggtgcaacggctcctggagctgtggcgtcggcggggcaagctgtgagcatagcaggtcaggcggcgcaaggtctgcgaagggtggtggaaattctagagcagctggaggctgtgatggaggttgtggctgctgtgaaggacctcgtggattcattggaacaggtaggtcagattgtggacgcaccggtgatgccggaattgccctcagaggcggactggtccatttttgtgaacgaggtggaggccgtggcagagggcatgccaacggaagtctcggaggttccggtgtggagggccaagtgcaagaatgtggctgcactgggtcgggagatgagcatcacggcagtacagatgtcggagctgcagtatgacatctgggtgcaaggcatgatgcgggatatggctcgaagccaggcagacaggctggccgcaattcaacccgcggaccttaccaactatttggagatggctacccagatggatatgcggactacgaggatgctgctggggctcctcaacatattgcgcatccagaatgcggcgctcaggtacgagtatcttctaatgcccacggagctcacaacatggccactgggtatggataccgtgggtgacttgctcatcgcgcaggagaatgctgcactgataggattaatgcagctagggccctcatctgatttcacgagcaggcatgtggtgaaagacatacctgtgaacttgctgctcgatggcgaggattgggagtttgagattcctgtgcaagctggcatgtccagcttcccttccagctggtctcgcgtccgtattcggcacctggagatgcactttgtgaaggaggccagcggtattggtggtgagattatccaccagcctaccacccagactgggaccgtttacatccttctgcagggttccactatcttccatgaccgcagaagagaccaggtgttgccttttcaggccgctgctccgctcaactaccattacgcgtaccgcctcgacaccggcgactccactctcacaaacgaaccctctgaacagtttgccaacaagttcatgcagatgacacccttcacccgttggaggcttcgtctgtctgcgtccgcaaaagagaatgcaggattagcctttcccacggctacagcacttgactccactacccagattgtcatcactttccatgttacggccatcagacaaattgactggcggcacgacgaagagtagc

SEQ ID NO: 725 - DNA, 2586 bp, Artificial Sequence
  encodes PtIP-83 polypeptide variant
atggattacagcacgctttacagggatctgaaccagataagcatgcccctggatcgggtagagttctcagaggtgatggtaatccacaggatgtacttgaggttatctgatctgaatgtggggcagctcgagggagccgagaaagtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaagtagcacaaaactacgaccgagaattcaagcaattcaaattattcatcatccaaaatcaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 726 - DNA, 2595 bp, Artificial Sequence
  encodes PtIP-83 polypeptide variant
atggctctcgtggattacggcaagcttttcgaggatctgaaccagataagcatgcccctggatcgggtagagttctcagaggtgatggtaatccacaggatgtacttgaggttatctgatctgaatgtgggggagctccccggagccgagagggtgaagcggttgtatgtgtttgcggacgtggtggagctaccagtcgtggaatggcggtggccgccgcaaataccaggatcggtgacggtgatcatattgtgtcgtcttcttcaatggccaactgatgggaggcagtcggacaccgagctccacctgacattcatgaagttgcatgccatacaacgagaggaaaatcggtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacaaactcttactcccacttaaggaatcgactcagttgcaaggaagcgagtcgtacaaggagtgccttgcactcttgggtcgtgttcacgctgcgatgaagatggtgagaattggcttagtagtgccccagctgcaatacagaatgtacggtagcctcatcaaccaaatggcccaggtagcacaaaactacgaccgagaattcaagcaattcaaattattcatcatccaaaatcaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 727 - DNA, 2601 bp, Artificial Sequence
  encodes PtIP-83 polypeptide variant
atggctctcgtggattacggcaagcttttcgaggatctgaaccagataagcatgggtgtactggatcgggtagagttttcagaggtgatggtgatccacaggatgtatgtgaggctagctgatctgaatgtggggcagctccccggagccgagagggtgaagcggttgtatgtgtttgcggacgtggtggagctaccagtcgtggaatggcggtggccgccgcaaataccaggatcggtgacggtgatcattctgtgtcgtcttcttcaatggccaactgatgggaggcagtcggacaccgagctccacctgacattcatgaagttgcatgccatacaacgggaggaaaatcagtgggagataaccgcagcagatggcatgaactggggagtttacatacacgcagaggaagtacaggttggcgtgctgacaatgtcatggtcttcggtacttagagtttcggcacttcgctctgttataacctccggctttcgcgccgttagtgtgtttgaggtaccgggaagtgtaaggtccacccttggagctactttaaggcccgatcacgccttatatagtacaactatgcaagccacacccaacgcatcgcatattagtgcttttaaccttcgcatagtttccccgtcggcatatcgtgtttgtcctctccaaaatgacacagatacctacttaggtattccagcagacgtggcggcagttcttccagtagacgtggtgactgatcctaacatcttgctgggcatgcagacaacggtacacattgcggagctagtcaaggcatgtcatccgtcacccgatgttgtgagcgctgtaggggagcacctgaactggctcaacgaagtcttgctccgagttgtccagaaggaatctcagttgcaagggaccgaggcctacaacgagtgccttgcgcttttaggtcgcattcaatgtgtcatgaagatggggccgtttgtctcggtagtgccgcagctgcaatacagaatgtacggtagcctcatcaaccaaatggcccaagtagcacaaaactacgaccaagatttcaggcaattcaaattattcatcatccaaaatcaaatccttggcagctatttgctgcagcagaacaaggcctttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatctgcagcgcaagctgtgaacatagccggtcaagcggcacaagctctgcgaagggtggtggaaattctagaggggctcgaggctgtgatggaggttgtggctgctataaagcaccttgtggatgctctggaccaggtaagtcagattgtggatgcaccacctatgccagacatgccctcggaggcggactggagtatttttgtgaatgagattgaagccgtggcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggatatagctcaaagccacgcagaccggctggcagcgattcagcctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcacgagagtgctgcactgtcaggattagctcagttagggcccccatcggacttcacgagcaggcatgtagtgaaaggcatacctgtgagcttgcttctagacggtggggattgggaatttgagattcctgtgcaaggtggcatgtccagtttcccttccagctggactcgagtgcggattcggcacctggagatgcactttgtgcaggaggcgagcggtggcggcgagattatccaccagcctgccacccagacggggaccatttacatcctcctgcagggctccactgtcttccatgatcgcagaagggaggaggtgatgacctttcaggcagcggttccgctcaactaccattacgcgtaccgcctcgacactggagaagccactcttacgaacgagccctcggaacagtttgccaacacattcatgcagatgacaccgttcactcactggaggctacgtctgtctgcgtccgcagcggagaataaaggattagcctttcccacagctacagctcccgactccaccactgagattgccatcactttccatgttacggccattagacaaattgactggcggcaagaggaggag

SEQ ID NO: 728 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAIKHLVDALDQVSQIVDAPPMPDMPSEADWSIFVNEIEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 729 - protein, 866 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAIKHLVDALDQVSQIVDAPPMPDMPSEADWSIFVNEIEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 730 - protein, 853 aa, Artificial Sequence
  PtIP-83 polypeptide variant
MDYSTLYRDLNQISMPLDRVEFSEVMVIHRMYLRLSDLNVGELPGAERVKRLYVLADVVELATFAHPQLLNTRMPGSVTVIILCRLLQFPTDGSFAAWLELPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGSESYKECLALLGRVHAAMKMVRIGLVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 731 - protein, 867 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAIKHLVDALDQVSQIVDAPPMPDMPSEADWSIFVNEIEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 732 - protein, 850 aa, Artificial Sequence
  PtIP-83 polypeptide variant
MDYSTLYRDLNQISMPLDRVEFSEVMVIHRMYLRLSDLNVGQLEGAERVKRLYVFADVVELPVVEWRWPPQIPGSVTVIILCRLLQFPTDGSFAAWLGLPFMELHTLIEQYRSEIKAADDAKWGTYVHAEEVQLSPLFNGWPYLVVEAQRCIITAAMHNTFNRPGWVRSITQFTTDQSGRVDTTLLARTEFGHIDLPLETDSPTAFSVSHRQSTNLPVEYTGIPVEVVTDPNILMGMQTSVHIAELVKACYPSPELVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAIKHLVDALDQVSQIVDAPPMPDMPSEADWSIFVNEIEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 733 - protein, 863 aa, Artificial Sequence
  PtIP-83 polypeptide variant
MDYSTLYRDLNQISMPLDRVEFSEVMVIHRMYLRLSDLNVGELPGAERVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILMGMQTSVHIAELVKACHPSPDVVSAVGVHVNWLNEVLLRVVQKESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAIKHLVDALDQVSQIVDAPPMPDMPSEADWSIFVNEIEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 734 - protein, 868 aa, Artificial Sequence
  PtIP-83 polypeptide variant
MALVDYGKLFEDLNQISMGVLDRVEFSEVMVIHRMYVRLADLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGVHVNWLNEVLLRVVQKESQLQGTEAYNECLALLGRIQCVMKMGPFVSVVPQLQYRMYGSLINQMAQVAQNYDREFKQFKLFIIQNQILGSYLLQQNRAFAERELQMESFHAAVISQRREELDNTFAKMDRLSGQMEAESSAMEQAKKEMDEGLRQFQNRQVANALFAVLSAVAQIGLAFLTAGATAPGAVASAGQAVSIAGQAAQGLRRVVEILEQLEAVMEVVAAVKDLVDSLEQVGQIVDAPVMPELPSEADWSIFVNEVEAVAEGMPTEVSEVPVWRAKCKNVAALGREMSITAVQMSELQYDIWVQGMMRDMARSQADRLAAIQPADLTNYLEMATQMDMRTTRMLLGLLNILRIQNAALRYEYLLMPTELTTWPLGMDTVGDLLIAQENAALIGLMQLGPSSDFTSRHVVKDIPVNLLLDGEDWEFEIPVQAGMSSFPSSWSRVRIRHLEMHFVKEASGIGGEIIHQPTTQTGTVYILLQGSTIFHDRRRDQVLPFQAAAPLNYHYAYRLDTGDSTLTNEPSEQFANKFMQMTPFTRWRLRLSASAKENAGLAFPTATALDSTTQIVITFHVTAIRQIDWRHDEE

SEQ ID NO: 735 - protein, 862 aa, Artificial Sequence
  PtIP-83 polypeptide variant
MDYSTLYRDLNQISMPLDRVEFSEVMVIHRMYLRLSDLNVGQLEGAEKVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAIKHLVDALDQVSQIVDAPPMPDMPSEADWSIFVNEIEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 736 - protein, 865 aa, Artificial Sequence
  PtIP-83 polypeptide variant
MALVDYGKLFEDLNQISMPLDRVEFSEVMVIHRMYLRLSDLNVGELPGAERVKRLYVFADVVELPVVEWRWPPQIPGSVTVIILCRLLQWPTDGRQSDTELHLTFMKLHAIQREENRWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNKLLLPLKESTQLQGSESYKECLALLGRVHAAMKMVRIGLVVPQLQYRMYGSLINQMAQVAQNYDREFKQFKLFIIQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAIKHLVDALDQVSQIVDAPPMPDMPSEADWSIFVNEIEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 737 - protein, 867 aa, Artificial Sequence
  PtIP-83 polypeptide variant
MALVDYGKLFEDLNQISMGVLDRVEFSEVMVIHRMYVRLADLNVGQLPGAERVKRLYVFADVVELPVVEWRWPPQIPGSVTVIILCRLLQWPTDGRQSDTELHLTFMKLHAIQREENQWEITAADGMNWGVYIHAEEVQVGVLTMSWSSVLRVSALRSVITSGFRAVSVFEVPGSVRSTLGATLRPDHALYSTTMQATPNASHISAFNLRIVSPSAYRVCPLQNDTDTYLGIPADVAAVLPVDVVTDPNILLGMQTTVHIAELVKACHPSPDVVSAVGEHLNWLNEVLLRVVQKESQLQGTEAYNECLALLGRIQCVMKMGPFVSVVPQLQYRMYGSLINQMAQVAQNYDQDFRQFKLFIIQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVNIAGQAAQALRRVVEILEGLEAVMEVVAAIKHLVDALDQVSQIVDAPPMPDMPSEADWSIFVNEIEAVAEGMPTEVSEVPAWKAKCKNVAALGREMCITAEQISQLQYDIWVQGLLRDIAQSHADRLAAIQPANLTNYLEMAIQMDMRTTRILIGLLNIMRIQNAALMYEYLLTPTQLTAWPLRMDTVANLLITHESAALSGLAQLGPPSDFTSRHVVKGIPVSLLLDGGDWEFEIPVQGGMSSFPSSWTRVRIRHLEMHFVQEASGGGEIIHQPATQTGTIYILLQGSTVFHDRRREEVMTFQAAVPLNYHYAYRLDTGEATLTNEPSEQFANTFMQMTPFTHWRLRLSASAAENKGLAFPTATAPDSTTEIAITFHVTAIRQIDWRQEEE

SEQ ID NO: 738 - DNA, 2538 bp, Polystichium tsus-simense
atggattacagcacgctttacagggatctgaaccaggtaagggtgcctgtggatagggcagagttctcagaggtgatggtgatccataggatgtatgtgaggttatctgatctggatgtgggggagctcgttggagccgagagagtgaagcggttgtacgtgtttgcggacgtggtggagcttgttccgcagactgtgtggtttagacaaattcaaatgccaggatcggtgacggtgatcatattgtgtcgtcttcttcaatttccaactgttgggtcgcaagctgaaactctccagctgcccttcatgaggttgcaggccatagtcaaagagcaaaataggtcggagataacagcagcagatgggatgaagtggggaacgtacatacacgggaacgaagtgcagcttcgttctaacaattccagatttgacgtctgggcacctcgctcgattataacctcagccattcacaatgtgctcaacgaacctgggagattagcttccaatactgtaattgcaagggctcagggagcagtgactactacgcgaatgtcagcctggctcagtcatcaaggtttcgtactccccacagtttccccaacggcatttagcgttttacctctccaaagtacgaatgtatccttcacaagtattcctgtggaggttgtcactgatcctaacatcttgctgggcatgcagaccaccctgcacattgcagagctagtcaaggtatgtcacccatcacccgacattgtgagcgctgtagcggagcacgcgatttggctcagcaaagtcttgcttcaagttgtccagaacgaatctcagttgcaagggaccgagtcctacaacgagtgccttgcgctcttgggtcgtgttcaatctgtgataaagatggggagatttggctcagtagtgccccagctgcaataccgaatgtacggcagcctcatcaatcaaatggctcaagtagcacaaaattacgaccgagaattcaagcaattcaagttgttcattatccaaaaccaaatccttggcagctacttgctgcagcagaacaaggcatttgctgacagggagctgcagatggagagctttcattctgcagtcatttctcatagagcccaggagttggacactgccatcgcaaagatggaccgattgagcttgcaaatggaggaagagaatagagcaatggagcaagccgaaaaggaaatgaacgaaggattgaggaggttccagaacgagcaagttgcaagggccatattttcagttcttagagctgtagctatgattgggcttgcatttgtcacgggtggtgcaacggctcctgcagctgtggcatccgcggggcaagctgtgagcatagccggtcaggccgcacaagctctgcgaagggtggtggaaattctagagggcctggcggctgtgatggaggtcgtggctgctgtgaaggaacttgtggcttcattggaacaggtaggtcagattgtggacgcaccggagatgccggacatgccctcggaggcggactggtccatttttgtgaatgagattgaggctgtggcagaggggatgccgacggaagtctcggaggttccgacgtggaaggccaagtgcaagaatgtggctgcactgggtagggagatgagcatcacggcagtacagatttctgagctccagtatcacatctgggtgcaaggcttgatgcgggatatagctcgaagtcaggcagacaggctggcggcgattcaacccgtggaccttacaaactatttggagatggcaacacagatggatatgcggactacgaggatgctgatagggctcctcaacatgctgcgcatccagaatgcggcactcatgtacgagtaccttctaacgcccatggagctcacagcatggccgctggaaatggataccatggccaacttactcatcgagcaggagaattctgcactgttaggattaattcagctagggccctcatcggatttcacaagcaggcatgtggtgaaaggcatacctgtgagcttgctgctcgatggtgaggattgggagtttgagatccctgtgcaacgtggcatgtccagcttcccttttagctggactcgagtccggattcggcacctggagatgcactttgtgcaggaggcgagcagcggcggcgagattatccatcagcctgccacccagacagggaccgtttacatcctcctgcagggctccactatcttccatgaccgcagaagagacgaggtgatgacctttcaggcagcggacccgctcaactaccaatacgcgtaccgtctcgacactggcgaagccacccttaccaacgagccctcagaacagtttgccaacacgttcatgcagatgacacccttcactcggtggaggcttcgtctctctgcgtccgccaaagagaatgcagggttagcctttcccacagctacagctcccgactccactaccgagattgtcatcacgttccacgttacggccattagacaaattgactggaggcaggaggtggaggag

SEQ ID NO: 739 - DNA, 2538 bp, Polystichium tsus-simense
atggattacagcacgctttacagggatctgaaccaggtaagggtgcctgtggatagggcagagttctcagaggtgatggtgatccataggatgtatgtgaggttatctgatctggatgtgggggagctcgttggagccgagagagtgaagcggttgtacgtgtttgcggacgtggtggagcttgttccgcagactgtgtggtttagacaaattcaaatgccaggatcggtgacggtgatcatattgtgtcgtcttcttcaatttccaactgttgggtcgcaagctgaaactctccagctgcccttcatgaggttgcaggccatagtcaaagagcaaaataggtcggagataacagcagcagatgggatgaagtggggaacgtacatacacgggaacgaagtgcagcttcgttctaacaattccagatttgacgtctgggcacctcgctcgattataacctcagccgttcacaatgtgctcaacgaaccggggagattagcttccaatactgtaattgcaagggctcagggagcagtgactactacgcgaatgtcagcctggctcagtcatcaaggtttcgtactccccacagtttccccaacggcatttagcgttttacctctccaaagtacgaatgtatccttcacaagtattcctgtggaggttgtcactgatcctaacatcttgctgggcatgcagaccaccctgcacattgcagagctagtcaaggtatgtcacccatcacccgacattgtgagcgctgtagcggagcacgcgatttggctcagcaaagtcttgcttcaagttgtccagaacgaatctcagttgcaagggaccgagtcctacaacgagtgccttgcgctcttgggtcgtgttcaatctgtgataaagatggggagatttggctcagtagtgccccagctgcaataccgaatgtacggcagcctcatcaatcaaatggctcaagtagcacaaaattacgaccgagaattcaagcaattcaagttgttcattatccaaaaccaaatccttggcagctacttgctgcagcagaacaaggcatttgctgacagggagctgcagatggagagctttcattctgcagtcatttctcatagagcccaggagttggacactgccatcgcaaagatggaccgattgagcttgcaaatggaggaagagaatagagcaatggagcaagccgaaaaggaaatgaacgaaggattgaggaggttccagaacgagcaagttgcaagggccatattttcagttcttagagctgtagctatgattgggcttgcatttgtcacgggtggtgcaacggctcctgcagctgtggcatccgcggggcaagctgtgagcatagccggtcaggccgcacaagctctgcgaagggtggtggaaattctagagggcctggcggctgtgatggaggtcgtggctgctgtgaaggaacttgtggcttcattggaacaggtaggtcagattgtggacgcaccggagatgccggacatgccctcggaggcggactggtccatttttgtgaatgagattgaggctgtggcagaggggatgccgacggaagtctcggaggttccgacgtggaaggccaagtgcaagaatgtggctgcactgggtagggagatgagcatcacggcagtacagatttctgagctccagtatcacatctgggtgcaaggcttgatgcgggatatagctcgaagtcaggcagacaggctggcggcgattcaacccgtggaccttacaaactatttggagatggcaacacagatggatatgcggactacgaggatgctgatagggctcctcaacatgctgcgcatccagaatgcggcactcatgtacgagtaccttctaacgcccatggagctcacagcatggccgctggaaatggataccatggccaacttactcatcgagcaggagaattctgcactgttaggattaattcagctagggccctcatcggatttcacaagcaggcatgtggtgaaaggcatacctgtgagcttgctgctcgatggtgaggattgggagtttgagatccctgtgcaacgtggcatgtccagcttcccttttagctggactcgagtccggattcggcacctggagatgcactttgtgcaggaggcgagcagcggcggcgagattatccatcagcctgccacccagacagggaccgtttacatcctcctgcagggctccactatcttccatgaccgcagaagagacgaggtgatgacctttcaggcagcggacccgctcaactaccaatacgcgtaccgtctcgacactggcgaagccacccttaccaacgagccctcagaacagtttgccaacacgttcatgcagatgacacccttcactcggtggaggcttcgtctctctgcgtccgccaaagagaatgcagggttagcctttcccacagctacagctcccgactccactaccgagattgtcatcacgttccacgttacggccattagacaaattgactggaggcaggaggtggaggag

SEQ ID NO: 740 - DNA, 2673 bp, Polystichium tsus-simense
atgacgatggcggcaattactgcacctcggaagtacagcgagctgtacaaagatttgaaccagataagcgagaggattaggctggatcagatggagttctcggaggtgatggtgatccataggatgtttataaagctggaggagttggacttagggtatctcgaaggagcggagagggtgaagcgcttgtacgtttttgcagatgtggtggaggtggaagaaggtggcaactttattgaggtgggcccattagcgagactgcctgggtcgatcgtggtagtcatactatgccgcgtcctgaaagtgggagtcgtcatgaacaattatctcaataatgccatgcgcgtgcagctcccgcacatgaagttgcgtttggtggaggtcacaacccagcccacaggtactaagctgcacatacatcgtgcagatgcagaagattatcaatatcctgccctctgcatacacgccagtgtcatacaatcttccatccgtctcgcaagcaccaatcgtcctcccacctaccctatccctcttcgattctttacctttatgcccgacagaggatccggagatgttgttttctcctccgaatctcggtccctgattgatgagcctgtcaatatcttctatgtatactcccatatgcctgaatttcgtcgttcactccccgtcccggaggccgccacacttgacccggcctcgctatccgatgattggtattatgttcatcttagccgtgtgaactctgtgatgtcgagctatgttgcggctgaaggagagctggaaccggcattctcactattgaaacccaaaatcccgttcgccgtactaacagatcctaacattttgctcgccatgcagaccagcctccttatcgcggagctagtggagcttgctcacccttcagcagacacagctgatgctgtagccaagcacgtggaatggctcagcaaaatcttgcttcaggctgtgtcgacggatgaggaagggatgttaaatccatctcatgatgagcacctcgcgctcttattccgtgcacaatacctgatgaagatgatgccagggaggacgcgcagcctcgtagtaccacaactgcagtatgacgtttatagcaacctcatcaatcgaatggctcaagtggccgaaagctacgaccaatcactaaggcagtttaaactcttcattgagcaaaacaagattcttggcagctacttgctacaacaaaataaggccttcgctgacagggaaagggatatggatgtttttcattccgagcttatctctcaacggaagattgaactggataacaccttactcaagatggatcaattaagcttacaaatggagactcaaagagaagacatggaccaagccaaaaatgacatggatgccggattgcgggaattccaaaatcgacaagttgcagcagctatgtttgccgtgatcggtgctatcgctgcgattggtcttgcctttgtaactggtggtgccactgctcctgccgccatggtagcagcaaagaccgccgtgacagcagcaggtgcggctgcacgggcgctggagcgagtgatagagatcttggattccttacaagcagtgatggagatggtctctctcataaaggagctggtgagttcgctggaagagataggtcaacttgtggaggcaccagagatgccagagatgccgacagaggcggactggttcatttttgagaacgagatagagggggtggcagagcagatgccaacagaggtgtcggaggtatcggcgtggaagacgaagtgcaagaatgtggcagtgttggggcgggagatgatcactacggcgtcttacatttcggagctgcaatacgacatcaaggtgcagggcatgctgcaggagattgccagaagccatgcgaatcggctgtcgagcatccaggcaacagatctgagcaactatacagagatggtgacacagatggacatgcggaccacacgaatgttggtggcgctcatcaaggtggtgcacatgcagaatgcagcactgatgtaccagtgcctatcaccgcccacatatgtgaatgcatggccagtgacaatggagacagtgtggaccatgctggtgcagcacgagcatgcagcggttctgggattgatgaggctagggccctccttcgatttcatgcgcacgtatgtggtggaggggattcctgtgcagctgctgcttgatggggaggattgggagttcgacattccagtggaagattacacaacgttcccgtccacatggtctcgcgtgcgtattcatcacttggaaatgaagtttgtgcaagccgcagatgtgcatcagcctatcactgatactggcacagtttacatgcttctgcagggctctcgcatcttccgcgaccgcaaccgagccgatgccattcattatgaggctgccatgtcgcttgactaccactatgcctaccgccttgacacaggagagaccaccctctccaatctgccctcccaagattttaccagaactttcatgcgcatgacgcccttcactaactggaggctccgtctgtctgcctctgctgaagaaaacaaagggctccgttttcccacggctacatctgccggctccactacccagattgccgtcattttctatatctcagctatcaggaaaatttctttc

SEQ ID NO: 741 - DNA, 2679 bp, Polystichium tsus-simense
atgacgatggcggcaactgcgcctcgggagtacagcgaactgtacaaggatttgaaccagataagcgagaggattaggctggatcagatggagttctcggaggtgatggtgatccacaggatgtttataaagctggaggagttggacttagggcatctcgaaggagcggagagggtgaagcgcttgtgcgtatttgcagatgtggtggaggtggaagaaggtggcaactttattgacgtggggccagtagcgagattgcctgggtcgatcatggtagtcatactatgccgcgtcctgaaagtcggagtcgtcatgagcgacttttatgtcaataatgccatgcgcctgcagctcccgcacatgaagttgcgtttggtggaggtcacaactcagcccacaggcactaagctgcacatacatcgtgcagatgcagaagattatcaatatcctgccctctgcatacacgccagtgtcatacaatcctccatccgtctcagaagcagctccaataatcgtcctcccaccttccctatccctcttcgattctttaactttaggcccgacagaggatccaacgatgtcgttttctcctccgaatctcggtccctgattgatgagcctgtcaatatcttctatgtatactcccatatgcctgcatttcttcatgcactccccatcccggaggcggccacaattgacccggcctcgctatccagtgattggtattatgtccatctcagccgtgtgaactctgtgttgtcgagctctgttgcggctgaaggagagctggaaccggcattctcactattgaaaccgaaaatcccattcgccgtactaacagatcctaacattttgctcgccatgcagaccagcctccttatcgcagagctagtggagcttgctcacccttcagcagacacagctgatgccgtagccaagcacgtggaatggctcagcaaaatcttgcttcaggctgtgtcgacagatgaggaagggatgttaaatccatctcatgatgagcacctcgcgctcttattccgtgcacaatacctgatgaagatgatgccagggaggacgcgcagcctcgtagtaccacaactgcagtatgacgtttacagcaacctcatcaatcgaatggctcaagtggccgaaagctacgaccaatcactaaggcagtttaaactcttcattgagcaaaacaagattcttggcagctacttgctacaacaaaataaggccttcgctgacagggaaagggatatggatgtttttcattccgagcttatctctcaacggaagattgaactggataacaccttactcaagatggatcaattaagcttacaaatggagactcaaagagaagacatggaccaagccaaaaatgacatggatgccggattgcgggaattccaaaatcgacaagttgcagcagctatgtttgccgtgatcggtgctatcgctgcgattggtcttgcctttgtaaccggtggtgccactgctcctgccgccatggtagcagcaaagaccgccgtgacagcagcgggtgcggctgcacgggcactggagcgagtgatagagatcttggattccttacaagcagtgatggagatggtctctctcataaaggagctggtgagttcgctggaagagataggtcaacttgtggacgcaccagagatgccagagatgccgacagaggcggactggttcatttttgagaacgagatagagggggtggcagagcagatgccaacagaggtgtcggaggtatcggcgtggaaaacgaagtgcaagaatgtggcagtgttggggcgggagatgatcactacggcgtcttatatttcggagctgcaatacgacatcaaggtgcaggcaatgctgcaggagattgccagaagccatgcgaatcggctgtcgagcatccaggcaacagatctgagcaactatacagagatggtgacacagatggacatgcggaccacacgaatgttggtggcgctcatcaaggtggtgcacatgcagaatgcagcactgatgtaccagtgcctatcaccgcccacatatgtgaatgcatggccagtgacaatggagacagtgtggaccatgctggtgcagcacgagcatgcagcggttctgggattgatgaggctagggccctccttcgatttcatgcgcacgtatgtggtggaggggattcctgtgcagctgctgcttgatggggaggattgggagttcgacattccagtggaagattacacaacgttcccgtccacatggtctcgtgtgcgtattcatcacttggaaatgaagtttgtgcaagccgcagatgtgcatcagcctatcactgataccggcacagtttacatgcttctccagggctctcgcatcttccgcgaccgcaaccgagccgatgccattcattacgaggctgccatgtcgcttgactaccactatgcctaccgccttgacacaggagagaccaccctctccaatctgccctcccaagatttcaccagaactttcatgcgcatgacgcccttcacgaactggaggctccgtctgtctgcctctgctgaagaaaacaaagggctccgttttcccacggctacatctgccggctccactacccagattgccgtcattttctatatctcagctatcaggaaaatttctttt

SEQ ID NO: 742 - DNA, 2553 bp, Rumohra adiantiformis
atggattacagcactctttacacggatctgaaccagataagcatgcccctggatcgggtagagttctcagaggtgatggtaatccacaggatgtacttgaggttatctgatctgaatgtgggggagctccccggagccgagagagtgaagcggttgtatgtgtttgcggatgtggtggagctcgcaacatttgcgtatccacagtttcttcatacgcggatgccaggatcggtgacggtgatcattctgtgtcgtcttcttcagtttccaactgatgggtcgttccctgcttggctcgagctgccgttcatggagttacacacactcatagaacaacacaggtcagagataaaagcagcagatgacgcgaactggggaacgtatgtacacgcggaggaagtacagctcagcccgctgtttaatgggtggccttatttggttgttgaggcacagcgctgtattataaccgcggccatgcacaatacatttaaccgcactgggtgggttcgctccgttactcaatttataaatgatcagtccggtcgggtagaaaccacactgctcgcacgaacagaattcggccatatttatctcccactcgagacagattccccaacggcattcagtgtttcacaccgccaaattacgaatttgcccgtagagtacaccggtattccagtagaggtggtgaccgatcctaacatcttgatgggcatgcagactagcgtgcacattgcggagctagtgaaggcatgttacccgtcaccagaattagtgagcgctgtaggggtgcacgtgaattggctcaacgaagtcttgctccgagttgtccagaacgaatctcagttgcaagggaccgaggcctacaacgagtgccttgcgcttttgggtcgcattcaatgtgtcatgaagatggggccgtttgtctcggtagtgccgcagctgcaatacagaatgtatggtagccttatcagacaaatggcccaggtagcacagaactacgaccaagatttcaggcagctcaagttattcattgcccaaaaccaaatccttggcagctatttgctgcagcagaacaaggcatttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatccgcagcgcaagctgtgagcatagccgttcaggccgcacaaggtcttcaaagggtggtggaaattctagaggggctggaggctgtgatggaggttgtggctgctataaaggaccttgtgggtgctctggaccaggtaagtcagattgtggatgcaccacctatgccagacatgccctcggaggcggactggagtatttttgtgaatgagattgaagccgtcgcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggaaatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcaggagagtgctgcactgtcaggattagctcagttagggcccccatcggacttcacgagcaggcatgtagtgaaagccatacctgtgagcttgcttctagacggtaaggattgggaatttgagattcctgtgcaaggtggcatgtccagtttcccttccagctggactcgagtgcggattcggcacctggagatgcactttgtgcaggaggcgagcggtggtggcgagattatccaccagcctgccacccagacggggaccgtttacatcctcctgcagggctccactgtcttccatgatcgcagaagggaggaggtgatgacctttcaggcagcggttccgctcaactaccattacgcgtaccgccttgacactggagaagccactcttacgaacgagccctcggaacagtttgccaacacattcatgcagatgacaccgttcactcactggaggctacgtctgtctgcgtccgcagcggagaatgaaggattagcctttcccacagctacagctcccgactccaccactgagattgccatcactttccatgttacggccattagacaaattgactggcggcaagaggag

SEQ ID NO: 743 - DNA, 2553 bp, Rumohra adiantiformis
atggattacagcactctttacacggatctgaaccagataagcatgcccctggatcgggtagagttctcagaggtgatggtaatccacaggatgtacttgaggttatctgatctgaatgtgggggagctccccggagccgagagagtgaagcggttgtatgtgtttgcggatgtggtggagctcgcaacatttgcgtatccacagtttcttcatacgcggatgccaggatcggtgacggtgatcattctgtgtcgtcttcttcagtttccaactgatgggtcgttccctgcttggctcgagctgccgttcatggagttacacacactcatagaacaacacaggtcagagataaaagcagcagatgacgcgaactggggaacgtatgtacacgcggaggaagtacagctcagcccgctgtttaatgggtggccttatttggttgttgaggcacagcgctgtattataaccgcggccatgcacaatacatttaaccgcactgggtgggttcgctccgttactcaatttataaatgatcagtccggtcgggtagaaaccacactgctcgcacgaacagaattcggccatatttatctcccactcgagacagattccccaacggcattcagtgtttcacaccgccaaattacgaatttgcccgtagagtacaccggtattccagtagaggtggtgaccgatcctaacatcttgatgggcatgcagactagcgtgcacattgcggagctagtgaaggcatgttacccgtcaccagaattagtgagcgctgtaggggtgcacgtgaattggctcaacgaagtcttgctccgagttgtccagaacgaatctcagttgcaagggaccgaggcctacaacgagtgccttgcgcttttgggtcgcattcaatgtgtcatgaagatggggccgtttgtctcggtagtgccgcagctgcaatacagaatgtatggtagccttatcagacaaatggcccaggtagcacagaactacgaccaagatttcaggcagctcaagttattcattgcccaaaaccaaatccttggcagctatttgctgcagcagaacaaggcatttgctgacagagaggtgcagatggagagctttcattcagcggtcatttctcaaagaaggcaggagttggacgacgccatcgctaagatggaccgactgagcttgcagatggaggaagaggacagagcaatggagcaagcccgaaaagaaatggaagaaggattgaagcagttccagaatgagcaagttgcaagggctgtgttcgctgttcttaaatctgtagctatgattgcgctcgcattcgtcacggctggtgcaacggctcctggggctgcagcatccgcagcgcaagctgtgagcatagccggtcaggccgcacaaggtcttcaaagggtggtggaaattctagaggggctggaggctgtgatggaggttgtggctgctataaaggaccttgtgggtgctctggaccaggtaagtcagattgtggatgcaccacctatgccagacatgccctcggaggcggactggagtatttttgtgaatgagattgaagccgtcgcagaggggatgccgacggaagtctcggaggttccggcgtggaaggccaagtgcaagaatgtggctgcactgggtagggagatgtgcatcacggcagaacagatttcccagctccagtatgacatctgggtgcaaggcttgttgcgggaaatagctcaaagccacgcagaccggctggcagcgattcaacctgctaatcttaccaactatttggagatggcaatacagatggatatgcggactacgaggatactgatagggctcctcaacataatgcgcatccagaatgcggcacttatgtatgagtaccttctaacgcccacgcagctcactgcatggccgctgagaatggatactgtggccaacttgctcatcacgcaggagagtgctgcactgtcaggattagctcagttagggcccccatcggacttcacgagcaggcatgtagtgaaagccatacctgtgagcttgcttctagacggtaaggattgggaatttgagattcctgtgcaaggtggcatgtccagtttcccttccagctggactcgagtgcggattcggcacctggagatgcactttgtgcaggaggcgagcggtggtggcgagattatccaccagcctgccacccagacggggaccgtttacatcctcctgcagggctccactgtcttccatgatcgcagaagggaggaggtgatgacctttcaggcagcggttccgctcaactaccattacgcgtaccgccttgacactggagaagccactcttacgaacgagccctcggaacagtttgccaacacattcatgcagatgacaccgttcactcactggaggctacgtctgtctgcgtccgcagcggagaatgaaggattagcctttcccacagctacagctcccgactccaccactgagattgccatcactttccatgttacggccattagacaaattgactggcggcaagaggag

SEQ ID NO: 744 - DNA, 2703 bp, Rumohra adiantiformis
atggctgcctccgctgctgctattcccgactacaaggagctgtacagagatttgaaccagataagtgagaggatgaggctggatcagatggatttctcggaggtgatggtgatccaccgcatgtatataaggctggaggagctagacttggggcatctggagggagccgacaaggtgaagcgcttgtacgtgcttgcagatgtggtggaggtggaagaaggtggcaacttcattgagcaagggcctgtagcaagattaccaggctccatcttggttgtcatactctgtagagtcctgcttgtgggcatcgtcatcaacgtgcatagtaatggtgaaaattttaataatgccatgcgcctccagcttccacacttgaagctgcgcgcggtcgagatcagcagcagcaccgacagcaactttaagctggagatgcatcgtgttgatcagacagcaggcgagtacaaccaatatcctgcccttaccgtaaacgcggatcttgtacagtgccgcatgcggtgggttattcatcgaccaccgatcacttccgtcagtttgtctcctatattcgtcgcttttatgccagaccgaggatctggagacgtcatcttttcctccgagtctcggtccatggttgatcgacctgttcagatgttttctgtctactctcacgtccctcgttttattcaaagccgtcccctcccactcccagaggaggtcacaatagacctgtcatcatgggagcccaaggaattttactctctctttgtcagtacagctcccacagtttctttgagcaaaagtgaagcagtagcaggagacctggagccagcgttctcgatattgaaaagaactgttcctgttgtcgtgctgacagatcccaacattttactggccatgcaggccagcctacttatcgcggaactagtgcagattgctcacccttcaccagacacagctgatgctgtagccaagcatgtggaatggctcaacaagctcttgattcaggcggcatcagacacggagggcactccagctcatcacgagtacctggcgctcttgttccgtgcacagtacgtcatgaagaagataggaaggacacgtcacctcgtagtgccgcaattgcaatacgacgtttatagtggtctcatcaatcgaatggctcaagtagctgagagttatgaccaatcactcaggcaatttaaactcttcattcaacaaaacaagattcttgggagctatctgctacagcaaaacagggcctttgctgacaaggaaagggacatggatgtattttattccgagcttatctctcaaagggaggttgaattgcaaagcaccctactaaaaatggatcaactgagctcacagatggagacacaacgcgaagacatggagcaagcgcaaaaagagatggaggaaggattgcgaagattccaaaatagagcagttgcaaatgctatgtttgccgtaattggagctgtggctgcaattggtcttgcattcctaaccggtggtgcaactgctcccggagctatggcagcagcagggaatgctgtgacggcagcgggtcaggctgccagggcgctgcaaagagtgctagatattttggaaggcttgcaagtagtgatggaagtgctgtctattatcaaggaactagtcgcttctttgcaagatctaggtcagcttgtggatgcacccgagatgccggaaatgccactggagtcggactggtacatttttgagaactctattgaggaagtggcggaggggatgccggaggaagtgtcagaggtaacggcatggaagaccaagtgcaagaatgtggcggtgctgggccgagagatgatcaccactgcagtatacatatcgcagctaatgtatgatatcaaggtgcagggcatgctgcaggagattgccaaaagccatgcgcaacggttggagaacatccaagcagcggatctgcaaggctatacagagatggtgacacagatggacatgcggaccacgcgcatgttggtggaactgatcaaggtggtgtatatgcagaatgcagcgcttatgtaccagagtttatcaccacccacagcagtgaatgcatggcccgtgacgatggagacagtgtggagcattctactgcagcatgaccatgctgctttgctggggttgctgaggctagggccttcctttgatttcatgcgcacctacacggtggaggatgttccggtgagcctgttgcttgatggtgaagactggcaattcgagatccctgtgcgagattacacagtctttccctccacctggtcgcgcgtgcgcattcatcacttggagatgaaatttgtcaaagctgctcatgtccaccagcccatcactgatacaggctccatttacgtgcttctgcagggctcgcgcatcttccgcgatcgcaacgaagatgaaaccattgattatgaggctgccctgccgcttgactaccactacgcctaccgccttgacacaggggagaccaccctttccaatctgccctctcaagaattcaccaagaccttcttgcgcatgacgcccttctccaacgcctggagattacgtctgtcttcctctgctgaagaaaacaaagggctggcctttcccactgctacggctgccgactccactacccagattgctatcaccttctacgtcaccgctatccggcgcatttctttc

SEQ ID NO: 745 - DNA, 2703 bp, Rumohra adiantiformis
atggctgcctccgctgctgctattcccgactacaaggagctgtacagagatttgaaccagataagtgagaggatgaggctggatcagatggatttctcggaggtgatggtgatccaccgcatgtatataaggctggaggagctagacttggggcatctggagggagccgacaaggtgaagcgcttgtacgtgcttgcagatgtggtggaggtggaagaaggtggcaacttcattgagcaagggcctgtagcaagattaccaggctccatcttggttgtcatactctgtagagtcctgcttgtgggcatcgtcatcaacgtgcatagtaatggtgaaaattttaataatgccatgcgcctccagcttccacacttgaagctgcgcgcggtcgagatcagcagcagcaccgacagcaactttaagctggagatgcatcgtgttgatcagacagcaggcgagtacaaccaatatcctgcccttaccgtaaacgcggatcttgtacagtgccgcatgcggtgggttattcatcgaccaccgatcacttccgtcagtttgtctcctagattcgtcgcttttatgccagaccgaggatctggagacgtcatcttttcctccgagtctcggtccatggttgatcgacctgttcagatgttttctgtctactctcacgtccctcgttttattcaaagccgtcccctcccactcccagaggaggtcacaatagacctgtcatcatgggagcccaaggaattttactctctctttgtcagtacagctcccacagtttctttgagcaaaagtgaagcagtagcaggagacctggagccagcgttctcgatattgaaaagaactgttcctgttgtcgtgctgacagatcccaacattttactggccatgcaggccagcctacttatcgcggaactagtgcagattgctcacccttcaccagacacagctgatgctgtagccaagcatgtggaatggctcaacaagctcttgattcaggcggcatcagacacggagggcactccagctcatcacgagtacctggcgctcttgttccgtgcacagtacgtcatgaagaagataggaaggacacgtcacctcgtagtgccgcaattgcaatacgacgtttatagtggtctcatcaatcgaatggctcaagtagctgagagttatgaccaatcactcaggcaatttaaactcttcattcaacaaaacaagattcttgggagctatctgctacagcaaaacagggcctttgctgacaaggaaagggacatggatgtattttattccgagcttatctctcaaagggaggttgaattgcaaagcaccctactaaaaatggatcaactgagctcacagatggagacacaacgcgaagacatggagcaagcgcaaaaagagatggaggaaggattgcgaagattccaaaatagagcagttgcaaatgctatgtttgccgtaattggagctgtggctgcaattggtcttgcattcctaaccggtggtgcaactgctcccggagctatggcagcagcagggaatgctgtgacggcagcgggtcaggctgccagggcgctgcaaagagtgctagatattttggaaggcttgcaagtagtgatggaagtgctgtctattatcaaggaactagtcgcttctttgcaagatctaggtcagcttgtggatgcacccgagatgccggaaatgccactggagtcggactggtacatttttgagaactctattgaggaagtggcggaggggatgccggaggaagtgtcagaggtaacggcatggaagaccaagtgcaagaatgtggcggtgctgggccgagagatgatcaccactgcagtatacatatcgcagctaatgtatgatatcaaggtgcagggcatgctgcaggagattgccaaaagccatgcgcaacggttggagaacatccaagcagcggatctgcaaggctatacagagatggtgacacagatggacatgcggaccacgcgcatgttggtggaactgatcaaggtggtgtatatgcagaatgcagcgcttatgtaccagagtttatcaccacccacagcagtgaatgcatggcccgtgacgatggagacagtgtggagcattctactgcagcatgaccatgctgctttgctggggttgctgaggctagggccttcctttgatttcatgcgcacctacacggtggaggatgttccggtgagcctgttgcttgatggtgaagactggcaattcgagatccctgtgcgagattacacagtctttccctccacctggtcgcgcgtgcgcattcatcacttggagatgaaatttgtcaaagctgctcatgtccaccagcccatcactgatacaggctccatttacgtgcttctgcagggctcgcgcatcttccgcgatcgcaacgaagatgaaaccattgattatgaggctgccctgccgcttgactaccactacgcctaccgccttgacacaggggagaccaccctttccaatctgccctctcaagaattcaccaagaccttcttgcgcatgacgcccttctccaacgcctggagattacgtctgtcttcctctgctgaagaaaacaaagggctggcctttcccactgctacggctgccgactccactacccagattgctatcaccttctacgtcaccgctatccggcgcatttctttc

SEQ ID NO: 746 - DNA, 2559 bp, Asplenium trichomanes
atggattacagcacgctttacagggatctgaaccagataagcatgcctgtggatcacgtagagttctcagaggtgatggtgatccatagaatgtatgtgaggttatctgatctggatgtgggggagctcgctggagcagagaaagtgaagcggctgtacttgtttgccgatgtggtggagcttgcaccggagcttgcaccggggaaacggacgcaaatgccaggatcgatcacggtgatcatattgtgtcgtcttcttcaatttccaactgatgggtcgcgagctgcaactctccagctgccgttcatgaagttgcatgccatactcagagagcgatataggtcagagataacagcagcagatggcacgaattggggaacgtacatccacggagacgaagtacaggtcagcccgctgtatactaacaattcggtacttccggtttgggcagatcgctctattataacctcagcctttcacaatgtgcttgacgaacctggtagagtaatttccagtactagtattacaatggctcaggcagcaccgaataatacgcgtatgacagccgaacccggttgggtctttggtaatcgttttctactctacacagtttcttcgacggcattcagtgttttacctctccaaagtacgaatatatccttcacaagcattccggtagaggtggtggctgatcctaacatcttgctgggcatgcagaccactgtgcacattgctgagctagtcaaggcatgtcgcccgtcacccgacatagtgagcgctgtagggcagcacgtgatttggctcaacaaagtcttgctccatgttgtgcagaacgaatctcagttgcaagggaccgaatcctacaacgagtgccttgcacttttgggtcgtgttcaatctgtgatgaagatcggcagatctggctcagtagtgccccagctgcaatacagaatgtatggtagcctcatcaaacaaatggcccaagcagcacaaaactatgaccaagaattcaggcagttcaagttattcatcatccaaaaccaaatcctgggcagctatttgctgcagcagaacaaggcatttgccgacagggagctgcagatggagagctttcattcagcggtcatttctcaaagaatgcaggagttggacactgccatcgcaaagatggaccgattgagcttgcaaatggaggaagagaacaaagcaatggagcaagcccagagggagatggacgaaggattgaggaggttccggaatgaacaagtcgcaagggccgtattttctgttcttagagctgtagctatgattgccctcgcattcgtcacgggtggtgcaacggctcctggagctgcggcgtccgcggggcaagccgtgagcatagcaggtcaggccgcacaagctctgcaaagggtggtggaaattctagatcggctggaggcggtgatggaggttgtggctgctgtgaaggaccttgtggattcattggaacaggtaggtcagattgtggaggcaccggtgatgccggacatgccctcggaggcggactggtccatttttgtgaatgagatcgaggctgtcgcagaggggatgccgacagaagtctcggaggttccggcgtggaaggccaagtgcaagaatgtggctgcactgggtagggagatgagcatcacggcagtacagatttctgagctccagtatgacatctgggtgcacggcttgatgcgggacatggctcgaagtcaggcagacaggctggcggcaattcaacccgcagaccttaccaactatttggagatggcaacacagatggatatgcggactacaaggatgctactagggctgctcaacatgctgcacatccagaatgcggcactcatgtacgagtaccttctgacgcccacagagctcacagcatggccgctgggcatggatatcgtggccaacttgctcatcgcgcaggagaatgctgcactgttaggattagttcagctagggcccccatcggatttcacgagcaagcatgtggtgaaaggcatacctgtgagcttgctgctcgacggtgaggattgggagttcgagatccctgtggaaggtggcatgtccagcttcccttctagctggactcgcgtacggattcggcacctggagatgcactttgtgcaggagatgagcggtggcagcgagattatccaccagcctgccacccagacggggactgtttacatcctcctgcagggctccactaccttccatgaccgcagaagggacgaggtgatgacctttcaggcagcggctccgctcaactaccattacgcgtaccgccttgacactggcgaagccactcttacgaacgagccctcggaacagtttgccaacacattcatgcagatgacacccttcacgcgctggaggcttcgtctctctgcgtctgccgcagagaatgcaggattaggctttcccacagctacagctcccgactccacgaccgagatagtcatcacgttccatgttacggccattagacaaattgactggcggcacgaggaggaggaggag

SEQ ID NO: 747 - DNA, 2481 bp, Asplenium trichomanes
atggattacagcacgctttacagggatctgaaccagataagcatgcctgtggatcacgtagagttctcagaggtgatggtgatccatagaatgtatgtgaggttatctgatctggatgtgggggagctcgctggagcagagaaagtgaagcggctgtacttgtttgccgatgtggtggagcttgcaccggagcttgcaccggggaaacggacgcaaatgccaggatcgatcacggtgatcatattgtgtcgtcttcttcaatttccaactgatgggtcgcgagctgcaactctccagctgccgttcatgaagttgcatgccatactcagagagcgatataggtcagagataacagcagcagatggcacgaattggggaacgtacatccacggagacgaagtacaggtcagcccgctgtatactaacaattcggtacttccggtttgggcagatcgctctattataacctcagcctttcacaatgtgcttgacgaacctggtagagtaatttccagtactagtattacaatggctcaggcagcaccgaataatacgcgtatgacagccgaacccggttgggtctttggtaatcgttttctactctacacagtttcttcgacggcattcagtgttttacctctccaaagtacgaatatatccttcacaagcattccggtagaggtggtggctgatcctaacatcttgctgggcatgcagaccactgtgcacattgctgagctagtcaaggtgcagaacgaatctcagttgcaagggaccgaatcctacaacgagtgccttgcacttttgggtcgtgttcaatctgtgatgaagatcggcagatctggctcagtagtgccccagctgcaatacagaatgtatggtagcctcatcaaacaaatggcccaagcagcacaaaactatgaccaagaattcaggcagttcaagttattcatcatccaaaaccaaatcctgggcagctatttgctgcagcagaacaaggcatttgccgacagggagctgcagatggagagctttcattcagcggtcatttctcaaagaatgcaggagttggacactgccatcgcaaagatggaccgattgagcttgcaaatggaggaagagaacaaagcaatggagcaagcccagagggagatggacgaaggattgaggaggttccggaatgaacaagtcgcaagggccgtattttctgttcttagagctgtagctatgattgccctcgcattcgtcacgggtggtgcaacggctcctggagctgcggcgtccgcggggcaagccgtgagcatagcaggtcaggccgcacaagctctgcaaagggtggtggaaattctagatcggctggaggcggtgatggaggttgtggctgctgtgaaggaccttgtggattcattggaacaggtaggtcagattgtggaggcaccggtgatgccggacatgccctcggaggcggactggtccatttttgtgaatgagatcgaggctgtcgcagaggggatgccgacagaagtctcggaggttccggcgtggaaggccaagtgcaagaatgtggctgcactgggtagggagatgagcatcacggcagtacagatttctgagctccagtatgacatctgggtgcacggcttgatgcgggacatggctcgaagccaggcagacaggctggcggcaattcaacccgcagaccttaccaactatttggagatggcaacacagatggatatgcggactacaaggatgctactagggctgctcaacatgctgcacatccagaatgcggcactcatgtacgagtaccttctgacgcccacagagctcacagcatggccgctgggcatggatatcgtggccaacttgctcatcgcgcaggagaatgctgcactgttaggattagttcagctagggcccccatcggatttcacgagcaagcatgtggtgaaaggcatacctgtgagcttgctgctcgacggtgaggattgggagttcgagatccctgtggaaggtggcatgtccagcttcccttctagctggactcgcgtacggattcggcacctggagatgcactttgtgcaggagatgagcggtggcagcgagattatccaccagcctgccacccagacggggactgtttacatcctcctgcagggctccactaccttccatgaccgcagaagggacgaggtgatgacctttcaggcagcggctccgctcaactaccattacgcgtaccgccttgacactggcgaagccactcttacgaacgagccctcggaacagtttgccaacacattcatgcagatgacacccttcacgcgctggaggcttcgtctctctgcgtctgccgcagagaatgcaggattaggctttcccacagctacagctcccgactccacgaccgagatagtcatcacgttccatgttacggccattagacaaattgactggcggcacgaggaggaggaggag

SEQ ID NO: 748 - DNA, 2712 bp, Phyllitis scolopendium 'Angustifolia'
atgggtgtcacagtcgttagcgacgagctgtgtctgctggacttggacgaagggagcgaggaatgggtgaaggatgaggaggcgataaaggcagcgaggagtagtacacctgaggtgaactacgaggccctgtatgcgaatgcaaaccagatagcgcgcgacctgcgagtggggagtgtgccatgtggagagctcctttctgtcaacggccggatgtttgtgcggctggacagcctggatgtgagccggctgcggcaacccgagcgagtgcagaacctcattgtgctggcagacgttgtggagatttctggcagggatctggtgctcccgggcgcctcctccgtgcgcatcatctgccggatcctccatctcagaagccgagacgtgcagctggaccttccttacgcgtggcgcacttcttcacaaacccagccctttcaattctccctccgtgcgcagcaaattgtcgtgtcgccctctgctgcgcctcccagcctttcctctactggtgccttagtggttcggctgcaccgcgagttaaatcaatgggctaccacaagaaccaggttcactcaatatgtcgtccgatgctttggctacacggcaagtagtgtaaactctaccgtcaatatcaacatccctgtctcagcagagacgccaccatcctttcactggctccgtgtgaactccgagaatctgaacctcaaggtcaaccaggatgctgtgtggcgtgcccatgtcgacgtccaggttgcgttgccgtcacagctggatctcaatgacctgcatgtcatgatgggtatggagtctaccctgctgactgcagagatgattcttagctatcgatcagatcgcccggacgttgttgctctggcagtagagcatgttgaatggatcagaatgagcttggtgcagaatcatgagcaacaacctaatcttcctgacaaccaatttgcactacttgctcgagcggaaatgcttgcaaaattgtcgatagatggaagccaaagcctggttgtcccgcagcttgagtacaccgcgtacagcgaagtgatcagacaaatcgctgttgtggccgaagcatacaatcaggaattcacacagctgcatctctttgtacaacaaactacgatacttggtgactatgttctcaatacagtgaaagctcttgctgagaaggagaaagacatcgccctcctggaggaggctgttgtgcgtggcaagcagtccgagctcgacattgccgtcgagaaaatagagaggttagagcaacaaatcctgaagcaaattgaagaggtgcaagaagccaaggaagacatggagaaaggtatcatcgcatacaggaatcggctgatcgcaaatgccttctttgaagtcctcagtgctgtcctacaaattgcagggtcatttgtgtattttaagacaggccaaattactgatgggctagcagcattgggaggaggtctcgcatccgcaaatcaggcaatctggctgatagtggatgcagtagacgcaaaaaattcactaagcaacatcaccgacaacctggtcgatgtggaaaaggcaatgaaagtggtgaacgctgtgctcgcattggtggataccgtcacaaacctggatgagctcttggatgctccacggatgcctgacgttgactcctcacattgggacatcatggagaacgagatcgagatagtggcagcgcaactgcccaccgaggtcagcgaggtccgggtgtggagcctcaaatgcaggaacgtggtgatcgtgtgccgtgaggtttgcacaactgctgctgccataatgcagctgcaatacgagctctttgtgcatgcaaggaagaaagagatttctgaaaggcatgcggagcgcttggcgcagatccaagcggtagacctgggggactacttggagctggcaagccaggctgacatgcgcacggtgcgactgctcatacagctactggacctgctggctacccagaacggagctctgcaatatcactacctactgccaccggagccattcgttggctggcctaccatagacaatgtgaggagaatgctggtggcacggcagcaacaagctgtcatttcacaaaccagcctaggtccgtcctaccgtgtcaggacacgcttggtgctcgattctgtccccgtgggcttgctactctctggtgaggactatagcttcacaatcgcgccgatcagcgagcaaagcatcccggtcttccccgctgtctggtcgcgtgtgcgcatcgaagagttgcaaatggtgttcactgccggtactacaggggcgcacatgccagtggctggtcccggcggcaaggtctacttactattacagccatcgtctacgttccacgatcggctgcgctaccaggccttcaactaccaggcggctgctccacggccgttccagtatgtatatgaccttgcgaccggcgagccatcgctggtgagcaggcccagtgagccaggcctctttctgcgcatgacaccgttcacacgctggaggcttcggctttcggcctccgcgtaccagaacgaagggatctccttccccaccgccactgcagccgacagcgtggccgaaatcaccatcaccttcgagcttacggctattgtccatccacaatcttttctcgaggaggatggcatcacgttcctcatgccgggcaagggtggcgatgatcaggtcgtcagctaa

SEQ ID NO: 749 - DNA, 2712 bp, Phyllitis scolopendium 'Angustifolia'
atgggtgtcacagtcgttagcgacgagctgtgtctgctggacttggacgaagggagcgaggaatgggtgaaggatgaggaggcgataaaggcagcgaggagtagtacacctgaggtgaactacgaggccctgtatgcgaatgcaaaccagatagcgcgcgacctgcgagtggggagtgtgccatgtggagagctcctttctgtcaacggccggatgtttgtgcggctggacagcctggatgtgagccggctgcggcaacccgagcgagtgcagaacctcattgtgctggcagacgttgtggagatttctggcagggatctggtgctcccgggcgcctcctccgtgcgcatcatctgccggatcctccatctcagaagccgagacgtgcagctggaccttccttacgcgtggcgcacttcttcacaaacccagccctttcaattctccctccgtgcgcagcaaattgtcgtgtcgccctctgctgcgcctcccagcctttcctctactggtgccttagtggttcggctgcaccgcgagttaaatcaatgggctaccacaagaaccaggttcactcaatatgtcgtccgatgctttggctacacggcaagtagtgtaaactctaccgtcaatatcaacatccctgtctcagcagagacgccaccatcctttcactggctccgtgtgaactccgagaatctgaacctcaaggtcaaccaggatgctgtgtggcgtgcccatgtcgacgtccaggttgcgttgccgtcacagctggatctcaatgacctgcatgtcatgatgggtatggagtctaccctgctgactgcagagatgattcttagctatcgatcagatcgcccggacgttgttgctctggcagtagagcatgttgaatggatcagaatgagcttggtgcagaatcatgagcaacaacctaatcttcctgacaaccaatttgcactacttgctcgagcggaaatgcttgcaaaattgtcgatagatggaagccaaagcctggttgtcccgcagcttgagtacaccgcgtacagcgaagtgatcagacaaatcgctgttgtggccgaagcatacaatcaggaattcacacagctgcatctctttgtacaacaaactacgatacttggtgactatgttctcaatacagtgaaagctcttgctgagaaggagaaagacatcgccctcctggaggaggctgttgtgcgtggcaagcagtccgagctcgacattgccgtcgagaaaatagagaggttagagcaacaaatcctgaagcaaattgaagaggtgcaagaagccaaggaagacatggagaaaggtatcatcgcatacaggaatcggctgatcgcaaatgccttctttgaagtcctcagtgctgtcctacaaattgcagggtcatttgtgtattttaagacaggccaaattactgatgggctagcagcattgggaggaggtctcgcatccgcaaatcaggcaatctggctgatagtggatgcagtagacgcaaaaaattcactaagcaacatcaccgacaacctggtcgatgtggaaaaggcaatgaaagtggtgaacgctgtgctcgcattggtggataccgtcacaaacctggatgagctcttggatgctccacggatgcctgacgttgactcctcacattgggacatcatggagaacgagatcgagatagtggcagcgcaactgcccaccgaggtcagcgaggtccgggtgtggagcctcaaatgcaggaacgtggtgatcgtgtgccgtgaggtttgcacaactgctgctgccataatgcagctgcaatacgagctctttgtgcatgcaaggaagaaagagatttctgaaaggcatgcggagcgcttggcgcagatccaagcggtagacctgggggactacttggagctggcaagccaggctgacatgcgcacggtgcgactgctcatacagctactggacctgctggctacccagaacggagctctgcaatatcactacctactgccaccggagccattcgttggctggcctaccatagacaatgtgaggagaatgctggtggcacggcagcaacaagctgtcatttcacaaaccagcctaggtccgtcctaccgtgtcaggacacgcttggtgctcgattctgtccccgtgggcttgctactctctggtgaggactatagcttcacaatcgcgccgatcagcgagcaaagcatcccggtcttccccgctgtctggtcgcgtgtgcgcatcgaagagttgcaaatggtgttcactgccggtactacaggggcgcacatgccagtggctggtcccggcggcaaggtctacttactattacagccatcgtctacgttccacgatcggctgcgctaccaggtcttcaactaccaggcggctgctccacggccgttccagtatgtatatgaccttgcgaccggcgagccatcgctggtgagcaggcccagtgagccaggcctctttctgcgcatgacaccgttcacacgctggaggcttcggctttcggcctccgcgtaccagaacgaagggatctccttccccaccgccactgcagccgacagcgtggccgaaatcaccatcaccttcgagcttacggctattgtccatccacaatcttttctcgaggaggatggcatcacgttcctcatgccgggcaagggtggcgatgatcaggtcgtcagctaa

SEQ ID NO: 750 - DNA, 2628 bp, Phyllitis scolopendium 'Angustifolia'
atggagtatggcagcttgtatggtgatgtgaaccaggtgagcctgaggttcgagaatacggaggtctctgaggtgatggtggtgcatcggatgcatgtgcggctggaggagctggacatgagcaacgacaagctcaaacgcctgtacgtgctggcggacgtggtggagctgccttcccagcgtaaaactatcgttatccccgccaccgtttcggcgataatcatgtgccgtgttctctacatcccttacatctggaccgtgtttgacaactgcaccgtcctcctcccgcacatgcgcttccgggtcgtcgaaacaagcctcacgctcagaactggccaattctttgccttaccctcctctgacaccgtcgacaacggcgccggcagctttggcggcctctacatccatgccgaccgcttcatctaccgccaggccacatcgtttacctccgactgggtccagcctctgcaacttcgggtacgaggcagctccaccttctcctcaaccttccgtgatcctgactggccagaaaccctacctgtcaccaacctcaatcaaaccatcaccctctccttgggctcattcctcacaccctccgactctgacttgcagagatctgacgagattgagttcctgcagacggagccccagagagtgcaagtggtatttaaccgacccggcggcacgaccggcgtggctttactcgtcgagaactcccctgaaatcagctttttccctgcaccatcgctggaacatgtccctgcagacgtcctcgccgatccttccatcatcttgggcatgcaaatgaacatgctcagtgccgagcttgtccgggctgctcacaattcgcagcaagtcatcaaagctgtcactaagcatgtggaatggctcagcaagatcttgcttcaggttgcttcaccgagtgatgacattctagcgctcttgtttcgcgtgcaagcattcattaagatggcaaagcaatcgcgctttgtggttccacggttacaataccacgtgtacagtaaccttatcaatcggatggtgcaagtagcccaggattatgaccaggagttcaggcaactcagacttttcattgcacaaaatgagatattgggaagctatttgctacagcaaaataaggctttcgcagataaggagaaggacatgagtgctttccactcgcaagttgtgtctatgaggagatccgagctgacctctaccatagaaatgatgggcaggctgagcttgcaaatggaaacggagggtgaggcgatggacgaagccagggacagtatggtcgaagcaattcaagaatatgaaaggaaacaacttgcaagggctctatttgcagtgcttggggcaatagcaagtgttgctcttgcatttgccactggaggtgcaactgcaccagcggcagtggcagcagctggagcggcagtcactgcagcaggtagattggcagaaggcctccgaagggttgtggagatcctcgaaggcttgcaagcgatcatggaggttgtggcagctataagagatctcgtagaatcactggaaaacatgggtcaactagtaggagctccggaaatgccagagatgcctacaaatgcagactggttaatttttgtaaatgaggtggaggcagtggcagagcaagtgccagaagaagtgtcagaggtcccagtgtggaaggccaagtgcaagaatgtggcggtgctagggcaagagatgtgcacaacagcagcacatattagcgagctacagtatcagataagggtggaagagatgctacaggagattgcacaacgtcaagcagacaggctaatggggatatcagcagcagatctatcaagctacacggagatggcaacacagatagacatgcgtacaactcggatgctccttcagctcatcaagatgttgtacattcagaatgctgcaatcaagtacgagtacttgtacgctgcgagtgagcggcttaactcatggccagtgaccatgcagacagtatggaccatgctcttgcaacaagagaatgcagctatcttgggcttgctagacttggggccctctaatgatttcacagtaacacatgttgttaaagacataccggtcaagttgttagttgatggttacgattggcattttgagatccctgtggaggattccgcaatcttcccggcaggatggtctcgtgttcggatacgctatgtcgagcttaaatttggcaaacagggtactgacagtaacattgtcatccaccagcctagcactaatactggcctaatctacgtgctcttacaaagctctcgtttcctcagtgatcgcaaacgggaggaggtgatggactatgaggcaagcacgggacttgcatatgcgtacgcctatgacctcagcacgggtgcaaccactctaactaacatcccctcagaggcacatgccaacacatttatgcaaatggcacccttcactgcctggaggcttcgtctctctgcctctgctatggaaaatcagggactggtgtttcctacagccacttctccggacaatactacccaaatctccatcacattctatgtcactgctattcgacggatagatactcgtcgacaacgagctgatgcggagtta

SEQ ID NO: 751 - DNA, 2652 bp, Phyllitis scolopendium 'Angustifolia'
atggagtactccgacttgtatgaggatgtgaaccaggtaagcttacgcttccagcagactgagttctccgaggtcatggtggtccatcgcatgtacttccgccttcttgacctcgacatgagcaccggaccctctttccttatgtttcccggcagcgagaaggtgcgccgcctctacatcgttgccgacattgtcgagcttcccgccaatggcatcaacatgcggcttcccgccaccgtatccgtcgtcatcctctgccgggttctctatgttcaggatgtcaactcgccctttctcacatgcggcctccatttccccttgatgcgcatgcgtgtggtggagacccaagagggcacggtccgtgtctttccggtccccgatagttcctcctcctccggaggtagtaccgacattggcctcttcatccacgccgatcgcttcatctaccggcaggacacctctacccttgaccctcttcagcccctgcaattgagagtgatcggaggttctacattctccacagtccgccctggttggccagaaactcttgaggtattctccctcattttgtggctcactctgtccaaggggcagcccattcctgccacagaatctgatttgcagagatctgacgaggttgagcttctgcccccaccttcccccgaccgactcctcgtagtctttaccggcctcgcacctggaaacatcggcagtatgtctgtggatgttgagtatatcggtgctggatttagctacttcagtatacccccggtggaccctgtccccacggaagttctctccgacccatacatcatcctgggcctacaaatgaacatgctcattgcagagcttgtcctggctgctcacaattctccgcgggtcatcaatgttgtcacgaagcatgtggaatggcttaacaagatattgcggcccaagcttgatttaccgaacgatgatattttaggacttctgtttcgtgtccaaaccttcttgaagatggctaagcagcctcgatctgtagtaccacggttgcaataccacatgtacagtagcctcatcaatcgcatggtgcaagtagcccaggtttacgatcaagatttcaagcaactcaaactcttcattgcgcaaaatcagatccttggcagctacttgttagaacaaaataaggcatttgcaagtaaagagaaggacatgagctctttccactctcaagtcgtgtcgctgcggagaaccgagctcaacaacgcaatagataagatggaccaattgagtgtgcaaatggaaaacgagaatcaagcaatggaccaggccaaagaggacatgatgcaagccattgaagaatatgagaagaagcaactcgccaacgctctttttgctgtgcttggagcgatagcgagtgttgcccttgcctttgcgacagctggtgcaaccgcacctgcggctgtggcggctgcgggggcagctgtgagtgcagcaggcagattggccgaaggtttgaaaaaagttgttgaaatattggaagggctggcagcagtgatggagattgttgcagtcataagggagcttgtagagtcactgcagaaccttggaagtctgattgacacaccggacatgccagacatgccatcggatgcagactggttgatctttgtgaatgaggtggaggctgttgcagagcaaatgccagcagatgtggttggttcggtggctgtgtggaaggcgaagtgcaagaacgtggctgtgcttgggcaggagatgtgcaccacagcggcacacatcggagagttaacataccagataaaggtggaagaaatgctacaagagattgcacaaaaacaagcaaacaggttggagggaataacacctgcagacttatcaagctacacagaaatgctttcacagatagacatgcgcaccactcgacagctgcttcagctcatccgggtgttgaacatccaaaatgcagcaatcaagtacgagtacttgtatgttgcaagcaggcagttggattcatggccggtgagtatggatactgtttggagcatgctcttgcagcaagagacctcagctatcacaggcttgttagacctgggaccctctaccgatttcacacgcacctttgtcgtcaaaaacattccggtgggactcttagttgatggtagagattggcagttcgtcatccccgtggaggattctccgacctttcccatcgggtactctcgtgttcgcatacgttatgtcgagctgaaattcgagcaagacagtaatgatggcagtgtcatccaccagcctcgcacaaacagcggcttgatatacatgctcttacaaaactctcaattgtttagtgatcggaggcggagggagatactggactatgaggcaagcatgggacttgcatatgcatttgcatacaatcttaccacgggagtgcctactctcaccaacatcccctccgatgagcatgccaacactttcatgcgaatgacgcccttcaataattggcgacttcgactctcttcctctgctgaggaaaatcggggattggcatttcccacggccaattctctagatgatatcacccaagtttccatcacattctacattactgctattcgtggaatagatacccgccgggaagtcgatgaggagtga

SEQ ID NO: 752 - DNA, 2640 bp, Phyllitis scolopendium 'Angustifolia'
atggagtatggcagcttgtatggtgatgtgaaccaggtgagcctgaggttcgagaagacggaggtctctgaggtgatggtggtgcatcggatgcatgtgcggctggaggagctggacatgagcagcgacaagctcaaacgcctgttcgtgctggcggacgtggtggagctgccttcccagcgtaaaactatcgttatccccgccaccgtttcggtgataatcatgtgccgcattctctacatcccttacatctggaccgtgctcgacaactgcaccgtcctcctcccgcacatgcgcttccgggtcgtcgaaacaagcatcgcgcccagagctggccaattctttgccttaccctcctctgactccgtcgacaacggcgccggcagcgttggcggcctctacatccatgccgaccgcttcatctaccgccagggcacatcgtttacctccgactggagccactccgactgggtccagcctctgcaactccgggtacaaggcagctccaccttctcctcaaccttccgtgatcctaactggccagaaaccctacctgtcaccaacctcaatcaaaccctcagcctctccttgggctcattcctcacaccctccgactctgacttgcagagatctgacgagattgagttcctggcgacggagccccagagagtgcaagtgatatttaaccgacccggcggctcgaccggcgtgcttttattcgtcgagaactcccctgaaatcagctttttccctgcaccatcgctgcaacatgtccctgcagacgtcctcgccgatccttccatcatcttgggcatgcaaatgaacatgctcagtgccgagcttgtcctggctgctcacaattcgcagcaagtcatcaaagctgtcactaagcatgtggaatggctcagcaagatcttgcttcaggttgcttcaccgagtgatgacattctagcgctcttgtttcgcgtgcaagcattcattaagatggcaaagcaatcgcgctttgtggttccacggttacaataccacgcgtacattaaccttatcaatcggatggtgcaagtagcccaggattatgaccaggagttcaggcaactcaggcttttcattgcacaaaatgagatattgggaagctatttgctacagcaaaataaggctttcgcagataaggagaaggacatgagtgctttccactcgcaagttgtgtctatgaggagatccgagctgacctctaccatagaaatgatgggcaggctgagcttgcaaatggaaacggagggtgaggcgatggacgaagccaaggacagtatggtcgaagcaattcaagaatatgaaaggaaacaacttgcaagggctctatttgcagtgcttggggcaatagcagctgttgctcttgcatttgccactggaggtgcaactgcaccagcggcagtggcagcagctggagcggcagtctctgcagcaggtagattggcagaaggcctccgaagggtcgtggagatcctccaaggcttgcaagagatcatggaggttgtggcagctataagagatctcgtagaatcactggaaaacatgggtcaacttgtagcagctcctgaaatgccagagatgcctacaaatgcagactggttaatttttgtaaatgaggtggaggcagtggcagagcaagtgccagaagaagtgtcagaggtcccagtgtggaaggccaagtgcaagaatgtggcggtgctagggcaagagatgtgcacaacagcagcacatattagcgagctacagtatcagataagggtggaagagatgctacaggagattgcagaacgtcaagcagacaggctaatggcgatatcagcagcagatctttcaagctacacggagatggcaacacagatagacatgcgtacaacgcggatgctccttcagctcatcaagatgttgtacattcagaatgctgcaatcaagtacgggtacttgtaccctgcgagtgagcggcttaactcatggccagtgaccatgcagacagtatggaccatgctcttgcaacaagagaatgcggctatcttgggcttgctagacttggggccctctaatgatttcacagtaacacatgttgttaaagacataccggtcaagttgttagttgatggttacgattggcattttgagatccctgtggaggattccgcaatcttcccggcaggatggtctcgtgttcggatacgctatgtcgagcttaaatttggcaaacagggtactgacagtaacattgtcatccaccagcctagcactaatactggcctaatctacgtgctcttacaaagctctcgtttcctcagtgatcgcaaacgggaggaggtgatggactacgaggcaagcacgggacttgcatatgcgtacgcctataacctcagcacgggtgcaaccactctaactaacatcccctcagaggcaaatgccaacacatttatgcaaatggcacccttcactgcctggaggcttcgtctctctgcctctgctatggaaaatcagggactggtgtttcctacagccacttctccggacaatactacccaaatctccatcacattctatgtcactgctattcgagggatagatcgtcgacaaggagctgatgcggagtta

SEQ ID NO: 753 - DNA, 2640 bp, Phyllitis scolopendium 'Angustifolia'
atggagtatggcagcttgtatggtgatgtgaaccaggtgagcctgaggttcgagaagacggaggtctctgaggtgatggtggtgcatcggatgcatgtgcggctggaggagctggacatgagcagcgacaagctcaaacgcctgttcgtgctggcggacgtggtggagctgccttcccagcgtaaaactatcgttatccccgccaccgtttcggtgataatcatgtgccgcattctctacatcccttacatctggaccgtgctcgacaactgcaccgtcctcctcccgcacatgcgcttccgggtcgtcgaaacaagcatcgcgcccagagctggccaattctttgccttaccctcctctgactccgtcgacaacggcgccggcagcgttggcggcctctacatccatgccgaccgcttcatctaccgccagggcacatcgtttacctccgactggagccactccgactgggtccagcctctgcaactccgggtacaaggcagctccaccttctcctcaaccttccgtgatcctaactggccagaaaccctacctgtcaccaacctcaatcaaaccctcagcctctccttgggctcattcctcacaccctccgactctgacttgcagagatctgacgagattgagttcctggcgacggagccccagagagtgcaagtgatatttaaccgacccggcggctcgaccggcgtgcttttattcgtcgagaactcccctgaaatcagctttttccctgcaccatcgctgcaacatgtccctgcagacgtcctcgccgatccttccatcatcttgggcatgcaaatgaacatgctcagtgccgagcttgtcctggctgctcacaattcgcagcaagtcatcaaagctgtcactaagcatgtggaatggctcagcaagatcttgcttcaggttgcttcaccgagtgatgacattctagcgctcttgtttcgcgtgcaagcattcattaagatggcaaagcaatcgcgctttgtggttccacggttacaataccacgcgtacagtaaccttatcaatcggatggtgcaagtagcccaggattatgaccaggagttcaggcaactcagacttttcattgcacaaaatgagatattgggaagctatttgctacagcaaaataaggctttcgcagataaggagaaggacatgagtgctttccactcgcaagttgtgtctatgaggagatccgagctgacctctaccatagaaatgatgggcaggctgagcttgcaaatggaaacggagggtgaggcgatggacgaagccaaggacagtatggtcgaagcaattcaagaatatgaaaggaaacaacttgcaagggctctatttgcagtgcttggggcaatagcagctgttgctcttgcatttgccactggaggtgcaactgcaccagcggcagtggcagcagctggagcggcagtctctgcagcaggtagattggcagaaggcctccgaagggtcgtggagatcctccaaggcttgcaagagatcatggaggttgtggcagctataagagatctcgtagaatcactggaaaacatgggtcaacttgtagcagctcctgaaatgccagagatgcctacaaatgcagactggttaatttttgtaaatgaggtggaggcagtggcagagcaagtgccagaagaagtgtcagaggtcccagtgtggaaggccaagtgcaagaatgtggcggtgctagggcaagagatgtgcacaacagcagcacatattagcgagctacagtatcagataagggtggaagagatgctacaggagattgcagaacgtcaagcagacaggctaatggcgatatcagcagcagatctttcaagctacacggagatggcaacacagatagacatgcgtacaacgcggatgctccttcagctcatcaagatgttgtacattcagaatgctgcaatcaagtacgggtacttgtaccctgcgagtgagcggcttaactcatggccagtgaccatgcagacagtatggaccatgctcttgcaacaagagaatgcggctatcttgggcttgctagacttggggccctctaatgatttcacagtaacacatgttgttaaagacataccggtcaagttgttagttgatggttacgattggcattttgagatccctgtggaggattccgcaatcttcccggcaggatggtctcgtgttcggatacgctatgtcgagcttaaatttggcaaacagggtactgacagtaacattgtcatccaccagcctagcactaatactggcctaatctacgtgctcttacaaagctctcgtttcctcagtgatcgcaaacgggaggaggtgatggactacgaggcaagcacgggacttgcatatgcgtacgcctataacctcagcacgggtgcaaccactctaactaacatcccctcagaggcaaatgccaacacatttatgcaaatggcacccttcactgcctggaggcttcgtctctctgcctctgctatggaaaatcagggactggtgtttcctacagccacttctccggacaatactacccaaatctccatcacattctatgtcactgctattcgagggatagatcgtcgacaaggagctgatgcggagtta

SEQ ID NO: 754 - protein, 846 aa, Polystichium tsus-simense
MDYSTLYRDLNQVRVPVDRAEFSEVMVIHRMYVRLSDLDVGELVGAERVKRLYVFADVVELVPQTVWFRQIQMPGSVTVIILCRLLQFPTVGSQAETLQLPFMRLQAIVKEQNRSEITAADGMKWGTYIHGNEVQLRSNNSRFDVWAPRSIITSAIHNVLNEPGRLASNTVIARAQGAVTTTRMSAWLSHQGFVLPTVSPTAFSVLPLQSTNVSFTSIPVEVVTDPNILLGMQTTLHIAELVKVCHPSPDIVSAVAEHAIWLSKVLLQVVQNESQLQGTESYNECLALLGRVQSVIKMGRFGSVVPQLQYRMYGSLINQMAQVAQNYDREFKQFKLFIIQNQILGSYLLQQNKAFADRELQMESFHSAVISHRAQELDTAIAKMDRLSLQMEEENRAMEQAEKEMNEGLRRFQNEQVARAIFSVLRAVAMIGLAFVTGGATAPAAVASAGQAVSIAGQAAQALRRVVEILEGLAAVMEVVAAVKELVASLEQVGQIVDAPEMPDMPSEADWSIFVNEIEAVAEGMPTEVSEVPTWKAKCKNVAALGREMSITAVQISELQYHIWVQGLMRDIARSQADRLAAIQPVDLTNYLEMATQMDMRTTRMLIGLLNMLRIQNAALMYEYLLTPMELTAWPLEMDTMANLLIEQENSALLGLIQLGPSSDFTSRHVVKGIPVSLLLDGEDWEFEIPVQRGMSSFPFSWTRVRIRHLEMHFVQEASSGGEIIHQPATQTGTVYILLQGSTIFHDRRRDEVMTFQAADPLNYQYAYRLDTGEATLTNEPSEQFANTFMQMTPFTRWRLRLSASAKENAGLAFPTATAPDSTTEIVITFHVTAIRQIDWRQEVEE

SEQ ID NO: 755 - protein, 846 aa, Polystichium tsus-simense
MDYSTLYRDLNQVRVPVDRAEFSEVMVIHRMYVRLSDLDVGELVGAERVKRLYVFADVVELVPQTVWFRQIQMPGSVTVIILCRLLQFPTVGSQAETLQLPFMRLQAIVKEQNRSEITAADGMKWGTYIHGNEVQLRSNNSRFDVWAPRSIITSAVHNVLNEPGRLASNTVIARAQGAVTTTRMSAWLSHQGFVLPTVSPTAFSVLPLQSTNVSFTSIPVEVVTDPNILLGMQTTLHIAELVKVCHPSPDIVSAVAEHAIWLSKVLLQVVQNESQLQGTESYNECLALLGRVQSVIKMGRFGSVVPQLQYRMYGSLINQMAQVAQNYDREFKQFKLFIIQNQILGSYLLQQNKAFADRELQMESFHSAVISHRAQELDTAIAKMDRLSLQMEEENRAMEQAEKEMNEGLRRFQNEQVARAIFSVLRAVAMIGLAFVTGGATAPAAVASAGQAVSIAGQAAQALRRVVEILEGLAAVMEVVAAVKELVASLEQVGQIVDAPEMPDMPSEADWSIFVNEIEAVAEGMPTEVSEVPTWKAKCKNVAALGREMSITAVQISELQYHIWVQGLMRDIARSQADRLAAIQPVDLTNYLEMATQMDMRTTRMLIGLLNMLRIQNAALMYEYLLTPMELTAWPLEMDTMANLLIEQENSALLGLIQLGPSSDFTSRHVVKGIPVSLLLDGEDWEFEIPVQRGMSSFPFSWTRVRIRHLEMHFVQEASSGGEIIHQPATQTGTVYILLQGSTIFHDRRRDEVMTFQAADPLNYQYAYRLDTGEATLTNEPSEQFANTFMQMTPFTRWRLRLSASAKENAGLAFPTATAPDSTTEIVITFHVTAIRQIDWRQEVEE

SEQ ID NO: 756 - protein, 891 aa, Polystichium tsus-simense
MTMAAITAPRKYSELYKDLNQISERIRLDQMEFSEVMVIHRMFIKLEELDLGYLEGAERVKRLYVFADVVEVEEGGNFIEVGPLARLPGSIVVVILCRVLKVGVVMNNYLNNAMRVQLPHMKLRLVEVTTQPTGTKLHIHRADAEDYQYPALCIHASVIQSSIRLASTNRPPTYPIPLRFFTFMPDRGSGDVVFSSESRSLIDEPVNIFYVYSHMPEFRRSLPVPEAATLDPASLSDDWYYVHLSRVNSVMSSYVAAEGELEPAFSLLKPKIPFAVLTDPNILLAMQTSLLIAELVELAHPSADTADAVAKHVEWLSKILLQAVSTDEEGMLNPSHDEHLALLFRAQYLMKMMPGRTRSLVVPQLQYDVYSNLINRMAQVAESYDQSLRQFKLFIEQNKILGSYLLQQNKAFADRERDMDVFHSELISQRKIELDNTLLKMDQLSLQMETQREDMDQAKNDMDAGLREFQNRQVAAAMFAVIGAIAAIGLAFVTGGATAPAAMVAAKTAVTAAGAAARALERVIEILDSLQAVMEMVSLIKELVSSLEEIGQLVEAPEMPEMPTEADWFIFENEIEGVAEQMPTEVSEVSAWKTKCKNVAVLGREMITTASYISELQYDIKVQGMLQEIARSHANRLSSIQATDLSNYTEMVTQMDMRTTRMLVALIKVVHMQNAALMYQCLSPPTYVNAWPVTMETVWTMLVQHEHAAVLGLMRLGPSFDFMRTYVVEGIPVQLLLDGEDWEFDIPVEDYTTFPSTWSRVRIHHLEMKFVQAADVHQPITDTGTVYMLLQGSRIFRDRNRADAIHYEAAMSLDYHYAYRLDTGETTLSNLPSQDFTRTFMRMTPFTNWRLRLSASAEENKGLRFPTATSAGSTTQIAVIFYISAIRKISF

SEQ ID NO: 757 - protein, 893 aa, Polystichium tsus-simense
MTMAATAPREYSELYKDLNQISERIRLDQMEFSEVMVIHRMFIKLEELDLGHLEGAERVKRLCVFADVVEVEEGGNFIDVGPVARLPGSIMVVILCRVLKVGVVMSDFYVNNAMRLQLPHMKLRLVEVTTQPTGTKLHIHRADAEDYQYPALCIHASVIQSSIRLRSSSNNRPPTFPIPLRFFNFRPDRGSNDVVFSSESRSLIDEPVNIFYVYSHMPAFLHALPIPEAATIDPASLSSDWYYVHLSRVNSVLSSSVAAEGELEPAFSLLKPKIPFAVLTDPNILLAMQTSLLIAELVELAHPSADTADAVAKHVEWLSKILLQAVSTDEEGMLNPSHDEHLALLFRAQYLMKMMPGRTRSLVVPQLQYDVYSNLINRMAQVAESYDQSLRQFKLFIEQNKILGSYLLQQNKAFADRERDMDVFHSELISQRKIELDNTLLKMDQLSLQMETQREDMDQAKNDMDAGLREFQNRQVAAAMFAVIGAIAAIGLAFVTGGATAPAAMVAAKTAVTAAGAAARALERVIEILDSLQAVMEMVSLIKELVSSLEEIGQLVDAPEMPEMPTEADWFIFENEIEGVAEQMPTEVSEVSAWKTKCKNVAVLGREMITTASYISELQYDIKVQAMLQEIARSHANRLSSIQATDLSNYTEMVTQMDMRTTRMLVALIKVVHMQNAALMYQCLSPPTYVNAWPVTMETVWTMLVQHEHAAVLGLMRLGPSFDFMRTYVVEGIPVQLLLDGEDWEFDIPVEDYTTFPSTWSRVRIHHLEMKFVQAADVHQPITDTGTVYMLLQGSRIFRDRNRADAIHYEAAMSLDYHYAYRLDTGETTLSNLPSQDFTRTFMRMTPFTNWRLRLSASAEENKGLRFPTATSAGSTTQIAVIFYISAIRKISF

SEQ ID NO: 758 - protein, 851 aa, Rumohra adiantiformis
MDYSTLYTDLNQISMPLDRVEFSEVMVIHRMYLRLSDLNVGELPGAERVKRLYVFADVVELATFAYPQFLHTRMPGSVTVIILCRLLQFPTDGSFPAWLELPFMELHTLIEQHRSEIKAADDANWGTYVHAEEVQLSPLFNGWPYLVVEAQRCIITAAMHNTFNRTGWVRSVTQFINDQSGRVETTLLARTEFGHIYLPLETDSPTAFSVSHRQITNLPVEYTGIPVEVVTDPNILMGMQTSVHIAELVKACYPSPELVSAVGVHVNWLNEVLLRVVQNESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVSIAVQAAQGLQRVVEILEGLEAVMEVVAAIKDLVGALDQVSQIVDAPPMPDMPSEADWSIFVNEIEAVAEGMPTEVSEVPAWKAKCKNVAALGREMCITAEQISQLQYDIWVQGLLREIAQSHADRLAAIQPANLTNYLEMAIQMDMRTTRILIGLLNIMRIQNAALMYEYLLTPTQLTAWPLRMDTVANLLITQESAALSGLAQLGPPSDFTSRHVVKAIPVSLLLDGKDWEFEIPVQGGMSSFPSSWTRVRIRHLEMHFVQEASGGGEIIHQPATQTGTVYILLQGSTVFHDRRREEVMTFQAAVPLNYHYAYRLDTGEATLTNEPSEQFANTFMQMTPFTHWRLRLSASAAENEGLAFPTATAPDSTTEIAITFHVTAIRQIDWRQEE

SEQ ID NO: 759 - protein, 851 aa, Rumohra adiantiformis
MDYSTLYTDLNQISMPLDRVEFSEVMVIHRMYLRLSDLNVGELPGAERVKRLYVFADVVELATFAYPQFLHTRMPGSVTVIILCRLLQFPTDGSFPAWLELPFMELHTLIEQHRSEIKAADDANWGTYVHAEEVQLSPLFNGWPYLVVEAQRCIITAAMHNTFNRTGWVRSVTQFINDQSGRVETTLLARTEFGHIYLPLETDSPTAFSVSHRQITNLPVEYTGIPVEVVTDPNILMGMQTSVHIAELVKACYPSPELVSAVGVHVNWLNEVLLRVVQNESQLQGTEAYNECLALLGRIQCVMKMGPFVSVVPQLQYRMYGSLIRQMAQVAQNYDQDFRQLKLFIAQNQILGSYLLQQNKAFADREVQMESFHSAVISQRRQELDDAIAKMDRLSLQMEEEDRAMEQARKEMEEGLKQFQNEQVARAVFAVLKSVAMIALAFVTAGATAPGAAASAAQAVSIAGQAAQGLQRVVEILEGLEAVMEVVAAIKDLVGALDQVSQIVDAPPMPDMPSEADWSIFVNEIEAVAEGMPTEVSEVPAWKAKCKNVAALGREMCITAEQISQLQYDIWVQGLLREIAQSHADRLAAIQPANLTNYLEMAIQMDMRTTRILIGLLNIMRIQNAALMYEYLLTPTQLTAWPLRMDTVANLLITQESAALSGLAQLGPPSDFTSRHVVKAIPVSLLLDGKDWEFEIPVQGGMSSFPSSWTRVRIRHLEMHFVQEASGGGEIIHQPATQTGTVYILLQGSTVFHDRRREEVMTFQAAVPLNYHYAYRLDTGEATLTNEPSEQFANTFMQMTPFTHWRLRLSASAAENEGLAFPTATAPDSTTEIAITFHVTAIRQIDWRQEE

SEQ ID NO: 760 - protein, 901 aa, Rumohra adiantiformis
MAASAAAIPDYKELYRDLNQISERMRLDQMDFSEVMVIHRMYIRLEELDLGHLEGADKVKRLYVLADVVEVEEGGNFIEQGPVARLPGSILVVILCRVLLVGIVINVHSNGENFNNAMRLQLPHLKLRAVEISSSTDSNFKLEMHRVDQTAGEYNQYPALTVNADLVQCRMRWVIHRPPITSVSLSPIFVAFMPDRGSGDVIFSSESRSMVDRPVQMFSVYSHVPRFIQSRPLPLPEEVTIDLSSWEPKEFYSLFVSTAPTVSLSKSEAVAGDLEPAFSILKRTVPVVVLTDPNILLAMQASLLIAELVQIAHPSPDTADAVAKHVEWLNKLLIQAASDTEGTPAHHEYLALLFRAQYVMKKIGRTRHLVVPQLQYDVYSGLINRMAQVAESYDQSLRQFKLFIQQNKILGSYLLQQNRAFADKERDMDVFYSELISQREVELQSTLLKMDQLSSQMETQREDMEQAQKEMEEGLRRFQNRAVANAMFAVIGAVAAIGLAFLTGGATAPGAMAAAGNAVTAAGQAARALQRVLDILEGLQVVMEVLSIIKELVASLQDLGQLVDAPEMPEMPLESDWYIFENSIEEVAEGMPEEVSEVTAWKTKCKNVAVLGREMITTAVYISQLMYDIKVQGMLQEIAKSHAQRLENIQAADLQGYTEMVTQMDMRTTRMLVELIKVVYMQNAALMYQSLSPPTAVNAWPVTMETVWSILLQHDHAALLGLLRLGPSFDFMRTYTVEDVPVSLLLDGEDWQFEIPVRDYTVFPSTWSRVRIHHLEMKFVKAAHVHQPITDTGSIYVLLQGSRIFRDRNEDETIDYEAALPLDYHYAYRLDTGETTLSNLPSQEFTKTFLRMTPFSNAWRLRLSSSAEENKGLAFPTATAADSTTQIAITFYVTAIRRISF

SEQ ID NO: 761 - protein, 901 aa, Rumohra adiantiformis
MAASAAAIPDYKELYRDLNQISERMRLDQMDFSEVMVIHRMYIRLEELDLGHLEGADKVKRLYVLADVVEVEEGGNFIEQGPVARLPGSILVVILCRVLLVGIVINVHSNGENFNNAMRLQLPHLKLRAVEISSSTDSNFKLEMHRVDQTAGEYNQYPALTVNADLVQCRMRWVIHRPPITSVSLSPRFVAFMPDRGSGDVIFSSESRSMVDRPVQMFSVYSHVPRFIQSRPLPLPEEVTIDLSSWEPKEFYSLFVSTAPTVSLSKSEAVAGDLEPAFSILKRTVPVVVLTDPNILLAMQASLLIAELVQIAHPSPDTADAVAKHVEWLNKLLIQAASDTEGTPAHHEYLALLFRAQYVMKKIGRTRHLVVPQLQYDVYSGLINRMAQVAESYDQSLRQFKLFIQQNKILGSYLLQQNRAFADKERDMDVFYSELISQREVELQSTLLKMDQLSSQMETQREDMEQAQKEMEEGLRRFQNRAVANAMFAVIGAVAAIGLAFLTGGATAPGAMAAAGNAVTAAGQAARALQRVLDILEGLQVVMEVLSIIKELVASLQDLGQLVDAPEMPEMPLESDWYIFENSIEEVAEGMPEEVSEVTAWKTKCKNVAVLGREMITTAVYISQLMYDIKVQGMLQEIAKSHAQRLENIQAADLQGYTEMVTQMDMRTTRMLVELIKVVYMQNAALMYQSLSPPTAVNAWPVTMETVWSILLQHDHAALLGLLRLGPSFDFMRTYTVEDVPVSLLLDGEDWQFEIPVRDYTVFPSTWSRVRIHHLEMKFVKAAHVHQPITDTGSIYVLLQGSRIFRDRNEDETIDYEAALPLDYHYAYRLDTGETTLSNLPSQEFTKTFLRMTPFSNAWRLRLSSSAEENKGLAFPTATAADSTTQIAITFYVTAIRRISF

SEQ ID NO: 762 - protein, 853 aa, Asplenium trichomanes
MDYSTLYRDLNQISMPVDHVEFSEVMVIHRMYVRLSDLDVGELAGAEKVKRLYLFADVVELAPELAPGKRTQMPGSITVIILCRLLQFPTDGSRAATLQLPFMKLHAILRERYRSEITAADGTNWGTYIHGDEVQVSPLYTNNSVLPVWADRSIITSAFHNVLDEPGRVISSTSITMAQAAPNNTRMTAEPGWVFGNRFLLYTVSSTAFSVLPLQSTNISFTSIPVEVVADPNILLGMQTTVHIAELVKACRPSPDIVSAVGQHVIWLNKVLLHVVQNESQLQGTESYNECLALLGRVQSVMKIGRSGSVVPQLQYRMYGSLIKQMAQAAQNYDQEFRQFKLFIIQNQILGSYLLQQNKAFADRELQMESFHSAVISQRMQELDTAIAKMDRLSLQMEEENKAMEQAQREMDEGLRRFRNEQVARAVFSVLRAVAMIALAFVTGGATAPGAAASAGQAVSIAGQAAQALQRVVEILDRLEAVMEVVAAVKDLVDSLEQVGQIVEAPVMPDMPSEADWSIFVNEIEAVAEGMPTEVSEVPAWKAKCKNVAALGREMSITAVQISELQYDIWVHGLMRDMARSQADRLAAIQPADLTNYLEMATQMDMRTTRMLLGLLNMLHIQNAALMYEYLLTPTELTAWPLGMDIVANLLIAQENAALLGLVQLGPPSDFTSKHVVKGIPVSLLLDGEDWEFEIPVEGGMSSFPSSWTRVRIRHLEMHFVQEMSGGSEIIHQPATQTGTVYILLQGSTTFHDRRRDEVMTFQAAAPLNYHYAYRLDTGEATLTNEPSEQFANTFMQMTPFTRWRLRLSASAAENAGLGFPTATAPDSTTEIVITFHVTAIRQIDWRHEEEEE

SEQ ID NO: 763 - protein, 827 aa, Asplenium trichomanes
MDYSTLYRDLNQISMPVDHVEFSEVMVIHRMYVRLSDLDVGELAGAEKVKRLYLFADVVELAPELAPGKRTQMPGSITVIILCRLLQFPTDGSRAATLQLPFMKLHAILRERYRSEITAADGTNWGTYIHGDEVQVSPLYTNNSVLPVWADRSIITSAFHNVLDEPGRVISSTSITMAQAAPNNTRMTAEPGWVFGNRFLLYTVSSTAFSVLPLQSTNISFTSIPVEVVADPNILLGMQTTVHIAELVKVQNESQLQGTESYNECLALLGRVQSVMKIGRSGSVVPQLQYRMYGSLIKQMAQAAQNYDQEFRQFKLFIIQNQILGSYLLQQNKAFADRELQMESFHSAVISQRMQELDTAIAKMDRLSLQMEEENKAMEQAQREMDEGLRRFRNEQVARAVFSVLRAVAMIALAFVTGGATAPGAAASAGQAVSIAGQAAQALQRVVEILDRLEAVMEVVAAVKDLVDSLEQVGQIVEAPVMPDMPSEADWSIFVNEIEAVAEGMPTEVSEVPAWKAKCKNVAALGREMSITAVQISELQYDIWVHGLMRDMARSQADRLAAIQPADLTNYLEMATQMDMRTTRMLLGLLNMLHIQNAALMYEYLLTPTELTAWPLGMDIVANLLIAQENAALLGLVQLGPPSDFTSKHVVKGIPVSLLLDGEDWEFEIPVEGGMSSFPSSWTRVRIRHLEMHFVQEMSGGSEIIHQPATQTGTVYILLQGSTTFHDRRRDEVMTFQAAAPLNYHYAYRLDTGEATLTNEPSEQFANTFMQMTPFTRWRLRLSASAAENAGLGFPTATAPDSTTEIVITFHVTAIRQIDWRHEEEEE

SEQ ID NO: 764 - protein, 903 aa, Phyllitis scolopendium 'Angustifolia'
MGVTVVSDELCLLDLDEGSEEWVKDEEAIKAARSSTPEVNYEALYANANQIARDLRVGSVPCGELLSVNGRMFVRLDSLDVSRLRQPERVQNLIVLADVVEISGRDLVLPGASSVRIICRILHLRSRDVQLDLPYAWRTSSQTQPFQFSLRAQQIVVSPSAAPPSLSSTGALVVRLHRELNQWATTRTRFTQYVVRCFGYTASSVNSTVNINIPVSAETPPSFHWLRVNSENLNLKVNQDAVWRAHVDVQVALPSQLDLNDLHVMMGMESTLLTAEMILSYRSDRPDVVALAVEHVEWIRMSLVQNHEQQPNLPDNQFALLARAEMLAKLSIDGSQSLVVPQLEYTAYSEVIRQIAVVAEAYNQEFTQLHLFVQQTTILGDYVLNTVKALAEKEKDIALLEEAVVRGKQSELDIAVEKIERLEQQILKQIEEVQEAKEDMEKGIIAYRNRLIANAFFEVLSAVLQIAGSFVYFKTGQITDGLAALGGGLASANQAIWLIVDAVDAKNSLSNITDNLVDVEKAMKVVNAVLALVDTVTNLDELLDAPRMPDVDSSHWDIMENEIEIVAAQLPTEVSEVRVWSLKCRNVVIVCREVCTTAAAIMQLQYELFVHARKKEISERHAERLAQIQAVDLGDYLELASQADMRTVRLLIQLLDLLATQNGALQYHYLLPPEPFVGWPTIDNVRRMLVARQQQAVISQTSLGPSYRVRTRLVLDSVPVGLLLSGEDYSFTIAPISEQSIPVFPAVWSRVRIEELQMVFTAGTTGAHMPVAGPGGKVYLLLQPSSTFHDRLRYQAFNYQAAAPRPFQYVYDLATGEPSLVSRPSEPGLFLRMTPFTRWRLRLSASAYQNEGISFPTATAADSVAEITITFELTAIVHPQSFLEEDGITFLMPGKGGDDQVVS

SEQ ID NO: 765 - protein, 903 aa, Phyllitis scolopendium 'Angustifolia'
MGVTVVSDELCLLDLDEGSEEWVKDEEAIKAARSSTPEVNYEALYANANQIARDLRVGSVPCGELLSVNGRMFVRLDSLDVSRLRQPERVQNLIVLADVVEISGRDLVLPGASSVRIICRILHLRSRDVQLDLPYAWRTSSQTQPFQFSLRAQQIVVSPSAAPPSLSSTGALVVRLHRELNQWATTRTRFTQYVVRCFGYTASSVNSTVNINIPVSAETPPSFHWLRVNSENLNLKVNQDAVWRAHVDVQVALPSQLDLNDLHVMMGMESTLLTAEMILSYRSDRPDVVALAVEHVEWIRMSLVQNHEQQPNLPDNQFALLARAEMLAKLSIDGSQSLVVPQLEYTAYSEVIRQIAVVAEAYNQEFTQLHLFVQQTTILGDYVLNTVKALAEKEKDIALLEEAVVRGKQSELDIAVEKIERLEQQILKQIEEVQEAKEDMEKGIIAYRNRLIANAFFEVLSAVLQIAGSFVYFKTGQITDGLAALGGGLASANQAIWLIVDAVDAKNSLSNITDNLVDVEKAMKVVNAVLALVDTVTNLDELLDAPRMPDVDSSHWDIMENEIEIVAAQLPTEVSEVRVWSLKCRNVVIVCREVCTTAAAIMQLQYELFVHARKKEISERHAERLAQIQAVDLGDYLELASQADMRTVRLLIQLLDLLATQNGALQYHYLLPPEPFVGWPTIDNVRRMLVARQQQAVISQTSLGPSYRVRTRLVLDSVPVGLLLSGEDYSFTIAPISEQSIPVFPAVWSRVRIEELQMVFTAGTTGAHMPVAGPGGKVYLLLQPSSTFHDRLRYQVFNYQAAAPRPFQYVYDLATGEPSLVSRPSEPGLFLRMTPFTRWRLRLSASAYQNEGISFPTATAADSVAEITITFELTAIVHPQSFLEEDGITFLMPGKGGDDQVVS

SEQ ID NO: 766 - protein, 876 aa, Phyllitis scolopendium 'Angustifolia'
MEYGSLYGDVNQVSLRFENTEVSEVMVVHRMHVRLEELDMSNDKLKRLYVLADVVELPSQRKTIVIPATVSAIIMCRVLYIPYIWTVFDNCTVLLPHMRFRVVETSLTLRTGQFFALPSSDTVDNGAGSFGGLYIHADRFIYRQATSFTSDWVQPLQLRVRGSSTFSSTFRDPDWPETLPVTNLNQTITLSLGSFLTPSDSDLQRSDEIEFLQTEPQRVQVVFNRPGGTTGVALLVENSPEISFFPAPSLEHVPADVLADPSIILGMQMNMLSAELVRAAHNSQQVIKAVTKHVEWLSKILLQVASPSDDILALLFRVQAFIKMAKQSRFVVPRLQYHVYSNLINRMVQVAQDYDQEFRQLRLFIAQNEILGSYLLQQNKAFADKEKDMSAFHSQVVSMRRSELTSTIEMMGRLSLQMETEGEAMDEARDSMVEAIQEYERKQLARALFAVLGAIASVALAFATGGATAPAAVAAAGAAVTAAGRLAEGLRRVVEILEGLQAIMEVVAAIRDLVESLENMGQLVGAPEMPEMPTNADWLIFVNEVEAVAEQVPEEVSEVPVWKAKCKNVAVLGQEMCTTAAHISELQYQIRVEEMLQEIAQRQADRLMGISAADLSSYTEMATQIDMRTTRMLLQLIKMLYIQNAAIKYEYLYAASERLNSWPVTMQTVWTMLLQQENAAILGLLDLGPSNDFTVTHVVKDIPVKLLVDGYDWHFEIPVEDSAIFPAGWSRVRIRYVELKFGKQGTDSNIVIHQPSTNTGLIYVLLQSSRFLSDRKREEVMDYEASTGLAYAYAYDLSTGATTLTNIPSEAHANTFMQMAPFTAWRLRLSASAMENQGLVFPTATSPDNTTQISITFYVTAIRRIDTRRQRADAEL

SEQ ID NO: 767 - protein, 883 aa, Phyllitis scolopendium 'Angustifolia'
MEYSDLYEDVNQVSLRFQQTEFSEVMVVHRMYFRLLDLDMSTGPSFLMFPGSEKVRRLYIVADIVELPANGINMRLPATVSVVILCRVLYVQDVNSPFLTCGLHFPLMRMRVVETQEGTVRVFPVPDSSSSSGGSTDIGLFIHADRFIYRQDTSTLDPLQPLQLRVIGGSTFSTVRPGWPETLEVFSLILWLTLSKGQPIPATESDLQRSDEVELLPPPSPDRLLVVFTGLAPGNIGSMSVDVEYIGAGFSYFSIPPVDPVPTEVLSDPYIILGLQMNMLIAELVLAAHNSPRVINVVTKHVEWLNKILRPKLDLPNDDILGLLFRVQTFLKMAKQPRSVVPRLQYHMYSSLINRMVQVAQVYDQDFKQLKLFIAQNQILGSYLLEQNKAFASKEKDMSSFHSQVVSLRRTELNNAIDKMDQLSVQMENENQAMDQAKEDMMQAIEEYEKKQLANALFAVLGAIASVALAFATAGATAPAAVAAAGAAVSAAGRLAEGLKKVVEILEGLAAVMEIVAVIRELVESLQNLGSLIDTPDMPDMPSDADWLIFVNEVEAVAEQMPADVVGSVAVWKAKCKNVAVLGQEMCTTAAHIGELTYQIKVEEMLQEIAQKQANRLEGITPADLSSYTEMLSQIDMRTTRQLLQLIRVLNIQNAAIKYEYLYVASRQLDSWPVSMDTVWSMLLQQETSAITGLLDLGPSTDFTRTFVVKNIPVGLLVDGRDWQFVIPVEDSPTFPIGYSRVRIRYVELKFEQDSNDGSVIHQPRTNSGLIYMLLQNSQLFSDRRRREILDYEASMGLAYAFAYNLTTGVPTLTNIPSDEHANTFMRMTPFNNWRLRLSSSAEENRGLAFPTANSLDDITQVSITFYITAIRGIDTRREVDEE

SEQ ID NO: 768 - protein, 880 aa, Phyllitis scolopendium 'Angustifolia'
MEYGSLYGDVNQVSLRFEKTEVSEVMVVHRMHVRLEELDMSSDKLKRLFVLADVVELPSQRKTIVIPATVSVIIMCRILYIPYIWTVLDNCTVLLPHMRFRVVETSIAPRAGQFFALPSSDSVDNGAGSVGGLYIHADRFIYRQGTSFTSDWSHSDWVQPLQLRVQGSSTFSSTFRDPNWPETLPVTNLNQTLSLSLGSFLTPSDSDLQRSDEIEFLATEPQRVQVIFNRPGGSTGVLLFVENSPEISFFPAPSLQHVPADVLADPSIILGMQMNMLSAELVLAAHNSQQVIKAVTKHVEWLSKILLQVASPSDDILALLFRVQAFIKMAKQSRFVVPRLQYHAYINLINRMVQVAQDYDQEFRQLRLFIAQNEILGSYLLQQNKAFADKEKDMSAFHSQVVSMRRSELTSTIEMMGRLSLQMETEGEAMDEAKDSMVEAIQEYERKQLARALFAVLGAIAAVALAFATGGATAPAAVAAAGAAVSAAGRLAEGLRRVVEILQGLQEIMEVVAAIRDLVESLENMGQLVAAPEMPEMPTNADWLIFVNEVEAVAEQVPEEVSEVPVWKAKCKNVAVLGQEMCTTAAHISELQYQIRVEEMLQEIAERQADRLMAISAADLSSYTEMATQIDMRTTRMLLQLIKMLYIQNAAIKYGYLYPASERLNSWPVTMQTVWTMLLQQENAAILGLLDLGPSNDFTVTHVVKDIPVKLLVDGYDWHFEIPVEDSAIFPAGWSRVRIRYVELKFGKQGTDSNIVIHQPSTNTGLIYVLLQSSRFLSDRKREEVMDYEASTGLAYAYAYNLSTGATTLTNIPSEANANTFMQMAPFTAWRLRLSASAMENQGLVFPTATSPDNTTQISITFYVTAIRGIDRRQGADAEL

SEQ ID NO: 769 - protein, 880 aa, Phyllitis scolopendium 'Angustifolia'
MEYGSLYGDVNQVSLRFEKTEVSEVMVVHRMHVRLEELDMSSDKLKRLFVLADVVELPSQRKTIVIPATVSVIIMCRILYIPYIWTVLDNCTVLLPHMRFRVVETSIAPRAGQFFALPSSDSVDNGAGSVGGLYIHADRFIYRQGTSFTSDWSHSDWVQPLQLRVQGSSTFSSTFRDPNWPETLPVTNLNQTLSLSLGSFLTPSDSDLQRSDEIEFLATEPQRVQVIFNRPGGSTGVLLFVENSPEISFFPAPSLQHVPADVLADPSIILGMQMNMLSAELVLAAHNSQQVIKAVTKHVEWLSKILLQVASPSDDILALLFRVQAFIKMAKQSRFVVPRLQYHAYSNLINRMVQVAQDYDQEFRQLRLFIAQNEILGSYLLQQNKAFADKEKDMSAFHSQVVSMRRSELTSTIEMMGRLSLQMETEGEAMDEAKDSMVEAIQEYERKQLARALFAVLGAIAAVALAFATGGATAPAAVAAAGAAVSAAGRLAEGLRRVVEILQGLQEIMEVVAAIRDLVESLENMGQLVAAPEMPEMPTNADWLIFVNEVEAVAEQVPEEVSEVPVWKAKCKNVAVLGQEMCTTAAHISELQYQIRVEEMLQEIAERQADRLMAISAADLSSYTEMATQIDMRTTRMLLQLIKMLYIQNAAIKYGYLYPASERLNSWPVTMQTVWTMLLQQENAAILGLLDLGPSNDFTVTHVVKDIPVKLLVDGYDWHFEIPVEDSAIFPAGWSRVRIRYVELKFGKQGTDSNIVIHQPSTNTGLIYVLLQSSRFLSDRKREEVMDYEASTGLAYAYAYNLSTGATTLTNIPSEANANTFMQMAPFTAWRLRLSASAMENQGLVFPTATSPDNTTQISITFYVTAIRGIDRRQGADAEL

SEQ ID NO: 770 - DNA, 57 bp, Artificial Sequence
  primer
cgaaatctctcatctaagaggctggatcctaggatggattacagcacgctttacagg

SEQ ID NO: 771 - DNA, 58 bp, Artificial Sequence
  primer
taagttggccaatccagaagatggacaagtctagactactcctccacctcctgcctcc

SEQ ID NO: 772 - DNA, 52 bp, Artificial Sequence
  primer
cgaaatctctcatctaagaggctggatcctaggatgacgatggcggcaactg

SEQ ID NO: 773 - DNA, 57 bp, Artificial Sequence
  primer
ggccaatccagaagatggacaagtctagactagaaagaaattttcctgatagctgag

SEQ ID NO: 774 - DNA, 58 bp, Artificial Sequence
  primer
cgaaatctctcatctaagaggctggatcctaggatggattacagcactctttacacgg

SEQ ID NO: 775 - DNA, 56 bp, Artificial Sequence
  primer
taagttggccaatccagaagatggacaagtctagactactcctcttgccgccagtc

SEQ ID NO: 776 - DNA, 52 bp, Artificial Sequence
  primer
cgaaatctctcatctaagaggctggatcctaggatggctgcctccgctgctg

SEQ ID NO: 777 - DNA, 58 bp, Artificial Sequence
  primer
taagttggccaatccagaagatggacaagtctagactagaaagaaatgcgccggatag

SEQ ID NO: 778 - DNA, 57 bp, Artificial Sequence; identical to SEQ ID NO: 770
  primer

SEQ ID NO: 779 - DNA, 58 bp, Artificial Sequence
  primer
taagttggccaatccagaagatggacaagtctagactactcctcctcctcctcgtgcc

SEQ ID NO: 780 - DNA, 55 bp, Artificial Sequence
  primer
cgaaatctctcatctaagaggctggatcctaggatgggtgtcacagtcgttagcg

SEQ ID NO: 781 - DNA, 58 bp, Artificial Sequence
  primer
taagttggccaatccagaagatggacaagtctagattagctgacgacctgatcatcgc

SEQ ID NO: 782 - DNA, 56 bp, Artificial Sequence
  primer
cgaaatctctcatctaagaggctggatcctaggatggagtatggcagcttgtatgg

SEQ ID NO: 783 - DNA, 56 bp, Artificial Sequence
  primer
gttggccaatccagaagatggacaagtctagactataactccgcatcagctcgttg

SEQ ID NO: 784 - DNA, 58 bp, Artificial Sequence
  primer
cgaaatctctcatctaagaggctggatcctaggatggagtactccgacttgtatgagg

SEQ ID NO: 785 - DNA, 56 bp, Artificial Sequence
  primer
taagttggccaatccagaagatggacaagtctagatcactcctcatcgacttcccg

SEQ ID NO: 786 - protein, 932 aa, Adiantum peruvianum
MATFEEYHPEQYMELYKDFNQVRERLSLEMMEFSEVMVIHRMYLKLEELDVGHLEGAEKVKHLYVFADVVEMRSREDELEPVARLPGSVSVAIICRVLWIRRQGSVTRETLIAFPHLKVHLKMTGARSVNVYRTHHAAETDDGFVLCIDAGSIQRTSDESTTSGILFSLFSYHFVRSPTLDGKNITFSSDTDSSISNLPVVHFPFYTQGWRWSVTTAGILSFAPSSVTSTTTVHATGSLQTYDFTHLTFAPGFWIMRGIPESLLKDDKLLLFLQTSLLISELAELAHPSSETRNAVLTHVEWLSKILINGESKTEGTEFHHEMQTSLLISELAELAHPSSETRNAVLTHVEWLSKILINGESKTEGTEFHHEYLALSFRAQYMLKTARSTRSLVVPQLQYDVYGPLINRMAQVAQIYDDAINQLKLFVSQNKILGSYLLEQNKTFAARERDMEVFYAELISQMKIELDSTLLKMDQLGAQMEAQSADMEEAQREMEEGLRRFRNRQVAEAMFSVFRAIGAIALAFLTGGATAPAAMSSARRAVTAAEQAARALARVLDILEGLQAVMEVVAIIKDLVESLQNVGQLVDAPDMPEMPTEADWGIFVNEIEGVAEEMPEEVSEVSAWKTKCKNVAVLGRELMTTAAYISRLQYDIQEHAMLQEIARRHADRLSTIQAADLSSYTEMVTQMDMRTTRIMVSLIKVIYMQNAALMYQCLAPPTQVWQWPSLSMETVWTMLMQNEHVAILGLTRLGPSFDFKRIYVVRDIPVSLLLAGQDWEFEIPVSDHTTFPSTWSRVRIQHLEMKFDAGGGAHQPITDTGKVYILLQGSRAFHDRNQVGRLPLLYEAALPLDYHYAYRLDTGETTLSNLPSTNFLDTYMRMTPFTNWRLRLSASAEENKGLDFPTARQESSIKEEATTQIAITFHVSAIRQISF

SEQ ID NO: 787 - protein, 728 aa, Adiantum peruvianum
TNHRHDKELFLPSMNMSMAAAGDMSFLGVNVSTTTVSSSSDVLEFKLQSGSMTSAMRLKDVDAAATLTCIVQTASPSMPLSVMTTGASPGNVWVLGMTTAVVVPASAVAVITDANILLGMQVTVQVAELVKTTHNSDVVIAASTRHVEWLNQLLVQAHAVAPNEDIVTLLYRTQALLKLQREGLVVPRLQYHMYKSLIDRMVQVAQSYDQDFNRLKLFVEQNKILGSYLLEQNKAFAEKEKEMDAFHAQVIELRTAELNGTIDRMDQLSEQMDKENEAMEQAKADMDAGLVEYQNRQVANALFAVLGAIASIGLAFATGGATAPAAVSAAGAAVTAAGQAAAGLRKVIEILEGLQVVMEVVAAIKELVQSLQEIGKLVDAPEMPELPSNADWEIFVNEVEAVAEQMPTEVTEVAAWKAKCKNVAALGREMSTMAAHIAELQYQIQVQEMLREIAQRQADRLSSIRPADLTNYLEMVSEMDMRTTRMLLELIRVLYIQNAALQYEYLQTPAPLSAWPVTMSTVWNLLVQQETAAITGLLELGPPSDFTREYAVKDIPVSLLQEGQDWEFELPVFSADFPSAWSRVRIHHLAMQFDGSAATHVPTTRTGKVYILLQSSRFFDDRAKRANELISYQAGMGLFYQYAYRLSTGEATVTNIPTDEYANTFMRSTPFTRWRIRLSSSAEENEGLAFPTATTADATTQIKITFSVSAIRRVSTRALTANGVVAKW

SEQ ID NO: 788 - protein, 525 aa, Adiantum hispidulum
VRMCAGSCTHANFIEAGSQERRNYLFPSLIISVCACVCVFQFPPLDGVDARSCIKMEYSSLYGDVNQVSLRFEKTEVSEVMVVHRMHVRLEELDMSSDKLKRLYVLADVVELPSQRSTIVVPATVSAIIICRVLYIPYIFTVLENCSFFLSLMRFRVVETRIEPPRTGQFFALPSADAVDDGVGGFRGLYILADRFIYRQATSFTSDWVQPLGLRVRGSSTFSYRQATSFTSDWVQPLSLRVQGSSTFSSTFRPEWPETLPVTNLNHTVTLSLGSFLTPSDSDLQRSDEIEFLPTEPQRVQVVINRGPGSQTGLVLIPENSPEISETEPQRVQVVVNRGPGSQTGLVLVVENSPEISFFPAPSLEHVPADVLADPSIILGMQMNMLSAELVLAAHNSQQVIKAVTKHVEWLNKILLQVASPSDDILALLFRAQAFIKMAKQSRFVVPRLQYHVYRNLINRMVQVAQDYDQELRQLRLFIAQNEILGSYLLQQNKAFAEKEKDMSDFHLQVVSMRRSLGKLFATAK

SEQ ID NO: 789 - protein, 904 aa, Adiantum hispidulum
MAAAAPAARRRDYKELYQDLNQISERMRLDQMDFSEVMVIHRMYIKLEELDLGHLEGAHKVKRLYVLADVVEVEEGSNLHDQGPLARLPGSILVVILCRVLLVGIFVNVRTGTLLNNVMRLQLPHIKLRAVEVRSSITDSNFTLQMHRAQSTGEIYDQYPALTINADLVQCRMRWVHQQPSITSVSLSPRFFAFMPDRGSQDVIFSSESRSMVDRPVQIFYIYSNVLNVIRSHRLPFPEEVTIDLASWEHKEFYYLHVSTAPSVTLSKPSETIQATELEPAFSLLKRSVPAAVLTDPNILLAMQASLLIAELVEIAHPSPDTADEVAKHVEWLNKLLIQAASEREGTSSHHEYLTLLFRAQYIMKKIGRARHLVVPQLQYDVYSGLINRMAQIAESYDQSLRQLILFIQQNKILGSYLLQQNRAFADKERDMDVFYSELISQREVELQSTLLKMDQLSLQMETQREDMEQAQKDMEAGLRRFQNRAVANAMFAVLGAVAAIGLAFLTGGATAPGAMAAAGNAVTIAGQAARALQRVLDILDGLQVVMEVVSLIKELVSSLQDLGQLVEAPEMPEMPLESDWFIFENSIEEVAEGMPEEVSEVSAWRTKCKNVAVLGREMISTAVYISQLMYDIKVQGMLQEIAKSHAQRLEAIQAADMQSYTEMVTQMDMRTTRMLVELIKVVYMQNAALMYQSLSPPTSVNAWPVTMETVWNILLQHDHAALLGLMRLGPSFDFMRTYIVQDIPVSLLLDGEDWQFEIPVRDFTSFPSTWSRVRIHHLEMKFVKATHVHQPITDTGSIYLLLQGSRIFRDRNEDETIDYEAALPLDYHYAYRLDTEETTLSNLPSQEFTKTFMRMTPFSNWRLRLSSSAEENKGLAFPTATSADSTTQIAITFYVTAIRRISF

SEQ ID NO: 790 - protein, 699 aa, Adiantum pedatum L.
RRAPCGGFSRSRTATGFSRLPANTGGQRVARVWQPISDYVDLFASVLPLNFARATHFVSSFEPAFWILTRGIPDSLLKDDKFLLAMQTSLLISELAQLAHPSSETRTAVLEHVRWLSAIVVDGASKTKGTELHREYLALSFRAQYMLKTASSTRSSLVVPQLQYDVYSPLINRMAQVTQIYDDALNQFKLFITQNGMHGSYLLEQNKALAARERDMEVFYSELISQMKIELDSTLLKMDQLGAQMEAQTEDMEQAQREMEQGLRRFKNRQVARAMFSVFAAIGAVALTFLTGGAAAPAAMSAARTAVTAAEQAARALQRVLDILEGLQAVMEVVALIKELVESLQDVGKLVEAPDMPEMPTEADWEIFVNEIEGVAAEMPEEVSEVSAWKTKCKNVAVLGREMTTTAAYISRLQYDIKEHAMLQEIAKRHADRLSTIQAADLSSYTEMVMQIDLRTTRIMVSLIKVIYMQNAALMYQYLAPPTHVWQWPSLSMEAVWTMLMQNEHIAILGLIRLGPSFDFKRTYVVRDIPVSLMLAGEDWEFTIPLSDHTTFPSTWSRVRIQHLEMKFVDDDDAASVHQPITNTGKVYILLQGSRAFHDRNQVGRLPLLYEAALPLDYHYAYCLDTGETTLSNLPSTSFLDTFMRMTPFTNWRLRLSVSAEENQGLDFPTARQQGTINEEATTQIAITFHVSAIRHVSF

SEQ ID NO: 791 - protein, 896 aa, Adiantum pedatum L.
MQLSGGQGQVYQSIMAAAAREYSELYKDLNQISERIRLDQMEFSEVMVIHRMFIRLEELDLGHLEGAERVKRLYVFADVVEVEEGGNFIETGPLARLPGSIMVVILCRVLSVRVLMFDNGNNAMRLQLPHMKLRVVEITTQPTTKLQIHRADAEDYQYPALCIHADVIQASIRLSSSSNRPPMDLRFFNFRPNRGSDNVVFSSESRSLIDEPVEIFYVYSHIPRFIHALPIPEAATVDPASRSNDWYYVSLRRVNSTLSSSVAAEGELEPAFSLLKPKIPVVVLTDPNILLAMQTSLLIAELVEVAHPSAETADAVAKHVEWLNKILLQATKVEGILNSSHDEHLALLFRAQYLMKMRPGRTRNLVVPQLQYDVYSNLVNRMAQVAESYDQSLRQFKLFIDQNKILGSYLLQQNKAFADKERDMDVFHSELISQRKIELDNTILKMDQLSLQMESQREDMDQAKKDMDAGLREFQNRQVANAMFAVIGAIAAIGLAFITGGATAPAAVGAAKTAVTAAGAAARALERVVEILDSLQAVMEIVSIIKELVSSLQEIGQLVEAPDMPPMPTEADWFIFENEIEGVAEQMPTEVSEVSAWKTKCKNVAVLGREMITTATYISELQYDIKVQGMLQEIATSHANRLSSIQATDLSNYTEMVTQMDMRTTRMLVALINVVHMQNAALMYQCLSPPTYVNAWPVTMETVWSMLVQHEHAAVLGLMRLGPSFDFMRTYVVEGIPVQLLLDGEDWEFEISVEDYTTFPSTWSRVRIHHLEMKFVQAADVHQPITDTGKVYMLLQGSRIFRDRNRADAIRYEAAMSLDYHYAYRLDTGETTLSNLPSQDFTRTFMRMTPFTNWRLRLSASAEENKGLGFPTATSAGSTTQIAIIFYISAIRRISL

SEQ ID NO: 792 - protein, 845 aa, Adiantum pedatum L.
VDYESIYKNAHEIGTVVGTDKIPCSEVMVCHRMYVNLDTFRVEQLVGYANVKQLIVFADVVEISCRWTYKLFLPFHTDFRIVCRLLKMKDDHEAIYLDWQRMDGRWMDSLYLPFHTDLRIVCRLLRMTEDHASIHLDWQLVNNSRCAIYAQELVSSTSNTPRLNLLVSRRTIHTNVPDRIIDIKNIVLYYNSQRDYDFTYFDEKTKVEYSYSVSVHFGSTPSVEVLAEDNILTGLQSTILITEMILNYRADLQDAVTAAFAHVTWVNLCLLQVVGRTDVKGADKLLSLLARVQALLKLPTDGSQSLIVPRLEYSAYEKLIAQMATVVESYNNEFVQLSLFIQQNEIMADYLLEQNKVFAAKEKDIAELESMIVDRKSQEMVKAFEKMNSLDAQLAQQVEEMDRAKEQMDAGIQKYKNDQVAKAFFSVIKCILSVGLAIVTGGAASGAAVAGTVAVVEKVSELANMLTKVTEILEGLEALAEILSAIKNLFEAIEDVNNIVEAPEMPEMPSAADWDIFENEIEAVAEQMPQTVSEVSLWKAKCKNVAAVCREISTTAAYIGQLEYDLFLHRKQQEIAAAQAKRLESIQPADLTNYLEMATQLDMRTTRLLVGMHKILTVQNGALQYHYLLEPKLLTGWPTMDRIRSRLVQNEQNAVLALERLGFSTDFVKTYVLSDVPVHLLLSGEDWNFNILEDDPTFPSNWSRVRIVYLEIKFSGDHLPITSTGEVYFLLQASRVFHDRLEGAYLKYEAGTPLEYQYAYILQTGKTTVTNKPTEEEDGKFLRMTPFTKWRLRLSASADENKGLSFPSAANALDSTTQISITFYLTAIRKISTRHGELGTTSDNE

SEQ ID NO: 793 - protein, 851 aa, Adiantum pedatum
MDVDYAAIYKDVNQVTRTVATSQCSEVMAIQRLYVRLNDLDVKGLRNVEVVKQVVVFADVVEVEGGDVLELPGSTQITIVCRVLHTKHPSGAVIRLSSLAPVKCHGREHRHASGPRTHSVTPMNGQLASDGQIVTILATEVVAPAGASLQVQCPVLVDAKIYDSDGYHPDFFYDLNGTASWSSLPFGGATGTTAATARSFQTTTIAPLSWITWTMNEVDWQPSFRVVLPETLPPRLLVNSSILLAMETNILASELISEFQREAVQTTAAVHQHTIWLDDQFQLAVRSSQRQDQLQSQQIRNLHFRVQSLLKLHRMDSNAPLVVPPLQYEQYDKLINLMTQAAQSYDNDFKNLNLFMQQNEILGNFLLDQNKAFAQKERDMEVHHSQLVGLQDRELELTREKFDSLLITLDQQNREMEKAQADLEAGIKQYRDRQIALAVFGALLAVAQLCFAVFTGGATAGAAVATAVQLSETAKVLQSVVKLLQRIEKVVTTLYAFIDFLSEMQSLEQIVNAPEMPELPTAADWYIFENEIVAVAETMPTEISEVPVWKAKCKNVAAVGREIITTAVYMQKLQYDLAVNRMLQQIAQQQAERLESLQIKDLDNYLEMATELDMRTTRILMGLLKVLSLQTGALSYHYLLEPRPLTGWVRMDAVWNALLKNATDAVVALSTSGASNDFVVRYTIKGIPVNLLLEGMDWIFDIPVDDPAFGESHWSRVRIEYIEMKFDSSSDGHLPTTTGGQIYFRLQAGRFFDDRLGHQILHYEAAVPLVYQYAYRLASGETTVSNRPSLSSSTHYMRMTPFTRWGLRLSASAPENRGLAFPTATTEDATTQITLTFYVTARRRISNFFLH

SEQ ID NO: 794 - protein, 766 aa, Adiantum pedatum
HYGFKANRYCAAGGVVIRLSSLSPVDCSAKLITDTTDIKPDDTVLQIDDFNWEVTPKTAAGRVVTILASHLVAPVGAQLRVHCPVNVEYQTNVIWPPVFTTVAGTVEWRISPYSAGASAAQSFAAATTSTFAGTAGLIWTVLKKWYPSFKIVLPEVIPLELLANSNIVLGVEVTTLVSELIMAYQRQATETVAATLHHVEWLNAQLLSAQSSGQLQALHFRVQSLLKLTVDDDNAPLVVPPLQYEVYDGLINVMTRAAESYDNAFVQLNLFMQQNEILGSFLLDQNKAFAAKERDMETHHSQLVSLQDAELTKTNESIKSMNNELAQQNQAMDKAKADMEAGIKQYKDRLIAEAVFGVFTAIAQVCLAIFTGGATAAAAVETAGKLSETAKALESAVKHLEKLQKIVQVINSITDFLSNLQSLNQLIEVPKMPDLPTEADWDMFENEIVAVAEGMPTEISEVPMWKAKCKNVAALGREIIRTVAYMQQLQYDLAVNRMLQNIAQQQAERLEGLHIQDLDNYTEMATELDTRTNRLLMGLLKVLSLQTGALSYHFLLPPRSLQGWVNMDTVWNTLVKNEYDAVRGLGSLGSAPTDTIQTYVVRDIPVGLLLEGNDWFFDIPVDDPAIPPPWFRVRIEHVELKFPTTNPIVHRPTTRNGEVYILLQAARFFSDRLIDEVLHFQATKTVSYQYAYRLDSGETTLHNRPTASSSTHYMRMTPFTRWRLRLSASAPQNEGLAFPTATTEDATTQITINFHLTALHRIQFRA

SEQ ID NO: 795 - protein, 881 aa, Adiantum pedatum
MAQGKELLTVDGVVDYEALYGEVNEIARAVRTHKVSCSEVMVINRMFVRLDTFSVEHLQQPGVVKSFIVVADVVEIEGSSSSLTLPGSSLILIVCRRLQLKNKNVILDLTWNLAATNVKSSQLPRCSIYTQHVDVPNAGSTLRIQVKRELKWSNGSSFTHYFGREFSYSNSTKTFSTTSSAPANYSVSSVGQPPASKLILVNSRKMNILTNDIRWKGFIDLQVNALPPLNDLAHPNVIEAFESNLLIVEMILNYQTNMQDLVTAAKDHVQWINQSFLEVVDWSNPEVGLQLKALLGRAQLLLKMPSDGSQSLIVPQLEYDGYDRVIQEMAKVAESYNREFRELSGLILNNEIIGQNILKQSKILGAKETEVQNLESLIVLRKEKELDRAIERLELLQNQLIRQVNEMETAKEKLDQGLKEYKHKQIARAFFQVLGAMMQIMGSCRLSSIPDFAVAFGGGISAAISAAEKVEDASVRNTLQNVANKLRNVEIVMEVVNSVKDLYTNASNLEDILNSPQIPDVPSSDWEIMRNDMEEVAAGMPTEVSEVSTWQAKSKNVVAVCEEICATAISISQTQCDLFVHVKQQEIAQRQAERLNQMQAVDLGDYLEMATQLDMRTMRVLICLLKMLGIQNGALQYQYLLAPKPFIGWPTIDTVRMEILRRVELAVLAKVELGSPVMLTRNYVIESIPVGLLISGDDWNFSFDASDNSVFPSTWSQVRIQYLEMKFTGEHCPITETGEVYLLLQASSKFEDRWKKQVFQYEAAAPLTYQYAYNLQSGKTTIPNKPHVEGTFLRMTPFTRWRLRLPASALENRGISFPTTTSLDNFISISITFHLTAIAQIQSKSLGIVYNLFDDDDDDDDEQGEGGEQGGGKSRGEEEVL

SEQ ID NO: 796 - protein, 890 aa, Adiantum pedatum
MAGAEDESMSTMYEGISTGSTAASDDELQDDMSFMYNYIQKSVDADRDSDYEAIYNGVNQIARAVGIRNRVESGEVLAIHQMFVRLDTLSVGNLLRAERVKYLIVFADVVEIEGADLTLPGSDLVLIACRLLRVKNQNVVLNLSWNIASSSTPPRCSICAQRVIITSSTAVANCTLRIQVMHALQWSDKSPFTQYFGRKFAYSSQNSSITAAPPNESSSSLGKPPSSRLILVNSKTMNILINNIRWKGYIDFQVGLPSSDDLIDPRVIEGIESTLLIAEMILTYQTNARDAVEAAKKHVQWINMALLQVVDSQNSEAGLRQKTLLARIQMLLKLSMDGTPGLVVSVLEYGIYDRVIQDLIRVAELYNNEFNQLNLFIQQNQILGDYVLEQSKVLAEREKDVEALESSIVARKQDELKESINTVESLEEQLQRLASEMEDAKDKMDKGLQAYRDKQIAYAFFTVLGAALQLGGSLKLSSSVEMVIGIGATVSEAVNATKEVTNAVASNNLMEVANKLVDVEKVIKVVNAIKELHDNETKLDDILTAPMMPVISSSDWDIMEDNIEEVAATMPTEVSEVVTWKTKSKNVIAVCREICTTAISVSETQYELFVHGKQQEIARRHTERLMKMKAADLGDYIEIAKQVDMQTMRLLIILLGNLAIQQGALHYHFLLAPEPLMSWPTIDTVRRHLIQQAEKAVWAEERMGEPVKLTQIYVLEDIPVSLLLAGNDWIFTIEPSETTVFPSNWYRVRIRYIEMKFTGENLPQSPETGRVYLLLQASSTFQDRSRGREVFQYEAATPRNYHFAYEVQSGVTTVHNEAAEGGRRFLMTPFTRWRLRLSASAIENQGVSFPVATSATISITFHLTCIVRVQSYRSQEDDEDEDEDEDEDGL

SEQ ID NO: 797 - protein, 883 aa, Adiantum pedatum
MVNERFLVDLDERSEEFVKDAQTRSTVSTEVDYEHLYANANQLARDLRTRNVRCGEVLAVHRMFVRLDSLDVQQLQQAERVKRLIVFADVVEIQGSSVALPGSSLVLIVCRVLHLKSRDVQLDLPFAWDTTAHDSPRCSIRAQQVVVSPSAAPPHLSSDGSLIIRVTHNMGWSNGSSFSQYIVRCFGYSESNSNSSVHINLPVATTRPPSFHWMRVDSEKVSIRINQNIDWTAHINFQVALPSADDLDNLHVVMGIESTLLIAEMILSYRSDRQDVVAAALEHTQWISMSLAQKEVVEGQPKSDLHELKLALLARAQMLQKLPLDGSQSLVVPQLEYGAYSEVIREMTDVAEAYNREFIQLHLFIQQNEILGDYILTAVRNLAEKEKDVASLEDAVVRGKEREIEIAMEKITTLEGQLLKQIEEMTDARDAMEQGVIVYRNKRIASATFEVLGAVLQIAGSIALFATGQIASGLGALGGGISAAVAAAEAVEDAASIKDSLLNVTDQLVEVEVAMEVVNAIQKLVASATDLEDLLAAPPMPIIYSSAWDIMENEVESVAAQMPTAVSEVPVWKAKCKNVVAVSREVCTTAIAISHLQYELFVHARKQEIALRQAERLAEMQAVDLGECLELASQADMRTTRMLINLLDMLATQNGALQYHYLLPPAPFVGWPAIDSVRTLLVQRRQQAIIAQTTMGPSYKVNTRVTLDSIPVGLLLSGEDFSFTIQAISEDTIATFPDVWSRVRIEDLSIVFTGGHQPSSSTTGEVYLLLQPSSSFHDRLRHQVLNYEAAAPRPFQYAYNLSTGHPTLTSRPHEEGLYLRMTPFTRWRLRLSSSAYQNRGISFPTATAPDSSTEITITFDLTAIVHPQTSVEYDNNPEIVDQP

SEQ ID NO: 798 - protein, 877 aa, Adiantum raddianum
MDVDYAADAMDVDYAEIYKEVNQVTRPVPTRVCSEVMSIQRMYFQLDDLDAKLLRNTEVVKRLYVFADVVEMVGQSVELAASVEVVILCRIFKTTRSDAVLRFLSLTSRLECDATPVYASANVVSHFFVRPRPGAADPRLLITIHATQLVAPARTQLRVQRPNVVLHRAQFWALEEIFMPGGVSTGATQPVLRPAVTQDGAMEWRISPYVAGGALAARSFHFTHPHVYRTSQDYLGFTGIFIPEPIPYDLLTNSNIWLGMECTTLICELIDKYQRQATQTVEAAHHHVAWLDKQLLSMGNRITSSNIPKKNVQQIETLHFRVQSLLKIYRRTANGVDAPLIVPSLQYDVYDRIINLMTRAAESYDNDFKQLNLFIQQNEILGSFLLDQNRAFAQKERDMENHHLQLVTLQGHELQATGDKLQALNRQLAEQSEAMDQAKADMDAGIKEYRDAMIANAIFSVFKAIAALCLAAATGGAAAGAAAGAAVDTAAQLSELARVLQSVVKLLKRIENVVKTINAITAFLTELESLNQLIELPEMPEMPTDADWSIFENEIEAVAEGMPTEISEVPAWKAKCKNVAAVGREIITTVAHVEKLQYEISVSKMLQDIAQQQAERLEGLRIEDLDNYLEMATELDMRTNRILMGLLDMLSLQTGALSYHYLLRPRPFTGWVRMETVWRTLLQNESDKLVAIAALGAPQEFSRSYVVENIPVSLLKEGADWIFDIPVHDPVFPSLWSSVRIDYVEMKFPPDTTHLPTTKGGKVYFLLQAARFFHDRLQEDEVLHYQAAVPLVYQYAYHVESGETTLSNRPPQASSALYMRMTPFTRWRLRLSASAPENEGLEFPTATTEDATTEIAITFFVTARRRISTRVDSSSTT

SEQ ID NO: 799 - protein, 874 aa, Adiantum raddianum
MAAVQDFSDVEDFSELYKNAEHVQMGSVPDYYEIYKNVNQVTRAVASSQCSEVMSIHRMCFKLDMLDVKLLTKADTVKRLIVFADVVEIEGDMVELPASTEVTIVCRILSVKKENRQVEENVQVFFNLLESVVTAGDRNDRPAGISLSTSPEFRFCIYAQQVVSNSVVHLRVTQPVTYSDPGFTPPDADTAWMWLSMRIRNLPSRQHMLNANGPRKANGMPVWQTSRNVIERGPEWSRISVLAPVSVPLHTLADPTVILGMQSTLLIAELILSYQTDLPDTVSAAVQHVEWLNTKLLRVVDDNTLDMETTQELLALLARGESLLKMPVDGSHTLIVPRLEYGQYRGLISSMATVAEAYNREFMQVDLFIQQNEILGSYLLQQNKALAERERDMEAFNGLVVARKQEELRAAEERMKELEALLTQQTEAMDQAQEDMEAGLKRYRDEQVARAFFSVLKGVFAIGVAIATGGAAAGPAVKGAVGAVNAVSGLARTLSTVTKIMEMMVQVIEVLNAMKDLIAAISELNQMVEAPQMPTMPSTVEWDIFENEMEEVAESMPEEVTEARTWKTKCKNVAAVCREISTTAAYIGQLHYDLFVHYNQEAIARRQAERLEAIQPANLTNYLEMATQMDMRTSRMLMGLLKVLMLQNGALQFHYLLQPKPFTGWVTMGMVRDALVQHEADALLARERLGPSTDFTQTYVVSDIPLSLLLEGEDWTFHIPPDDSTFPLSWSRVRIRYLEMNFTGGEEFHRPTTNTGRVYMLLQASRFFQDRLLGEVLHYEAAVPLRYQYAYDLKSGETTTSNRPSDQHDGEFMQMTPFNQWRLRLSASADENRGLAFPTAPPDQLDGSNTQISITFYLTAVRRAATRTSEISSQ

SEQ ID NO: 800 - protein, 882 aa, Adiantum trapeziforme
MATFEEYHPEQYMELYKDFNQVRERLSLEMMEFSEVMVIHRMYLKLEELDVGHLEGAEKVKHLYVFADVVEMRSREDELEPVARLPGSVSVAIICRVLWIRRQGSVTRETLIAFPHLKVHLKMTGARSVNVYRTDHAAETDDGFVFCIDAGSIQRTSDESTTSGILFSLFSYHFVRSPTLDGKNITFSSDTDSSISNLPVVHFPFYTQGWRWSVTTAGILSFAPSSVTSTTTVHATGSLQTYDFTHLTFAPGFWIMRGIPESLLKDDKLLLFMQTSLLISELAELAHPSSETRNAVLTHVEWLSKILINGESKTEGTEFHHEYLALSFRAQYMLKTARSTRSLVVPQLQYDVYGPLINRMAQVAQIYDDAINQLKLFVSQNKILGSYLLEQNKTFAARERDMEVFYAELISQMKIELDSTLLKMDQLGAQMEAQSADMEEAQREMEEGLRRFRNRQVAEAMFSVFRAIGAIALAFLTGGATAPAAMSSARRAVTAAEQAARALERVLDILEGLQAVMEVVAIIKDLVESLQNVGQLVDAPDMPEMPTEADWGIFVNEIEGVAEEMPEEVSEVSAWKTKCKNVAVLGRELMTTAAYISRLQYDIQEHAMLQEIARRHADRLSTIQAADLSSYTEMVMQMDMRTTRIMVSLIKVIYMQNAALMYQCLAPPTQVWQWPSLSMETVWTMLMQNEHVAILGLTRLGPSFDFKRIYVVRDIPVSLLLAGQDWEFEIPVSDHTTFPSTWSRVRIQHLEMKFDAGGGAHQPITDTGKVYILLQGSRAFHDRNQVGRLPLLYEAALPLDYHYAYRLDTGETTLSNLPSTNFLDTYMRMTPFTNWRLRLSASAEENKGLDFPTARQESSIKEEATTQIAITFHVSAIRQISF

SEQ ID NO: 801 - protein, 893 aa, Adiantum trapeziforme
MAAPAATEHGGLDYRELYKDLNQISDSLMLDQMEFSEVMVIHRMYIKLEELDLGHLEGADKVKRLYVFADVVDVEDGGNFIDVGPLARLPGSMTVVILCRVLYVRVLPLAVGGNNNAMRMQLPHMKFRVVEIATGRVQLQRVEQSGDELALCIHARIIQCYIRPSASATIRPPYSLRFLHFAPGRGVPGIVFSSEPRSMVDAQVELFQVYSHLGHVFQAPGPDQIVSINPASLATDWYYVSVSFPDRVVLSSSNAARGELEPAFSLLKPDIPVVVLTDPNVSLLIQTSLLIAELVELAHPSADTTAAVAEHLQWLNSLLLQATAEVKEGTASHDEYLGLLFRAQYLVKMMGRARSLVVPQLQYDVYSNLINRMAQVAESYDQALRQFRLFILQNKILGSYLLAQNRAFAEREKDMEVFHSELLSQRKLELETAIQKMDHLSIQMETQSADMEQAKKDMDEGLRRFQNAAVANAMFAVFGAIAAISLAFLTGGATAPGAVAAAKGAVTAAGALARALERVVEILEGLQAVMELVYLIKELMNSLKEVGQLVEAPEMPELPSEADWGIFVNEIEGVAEQMPTEVSEVSAWKTKCKNVAVLGREMITTATYISQLQYDIKVQDMLQGIARNQADRLLSIQAADLSNYTAMVTEMDMRTTRMLVALIKVVHMQNAALMYECLSLPMHVNAWPVTMETVWSMLVQHEHAAILGLMRLGPSFDFMSTYVAKDIPVSLLLDGEDWELDIPVDDYNTFPSTWSRVRIHHLEMKFVQGNEGSAGNIIHQPITDTGSVYLLLQGSRLFRDRNQSDVLNYEAAMSLDYHYAYRLDTGETTLSNLPSQDFTRTFMRMTPFTTWRLRLSASAQENQGLAFPTATSADSTTQIVITFYISAIRRISL

SEQ ID NO: 802 - protein, 833 aa, Asplenium australasicum
MRCPLNADITNSSRDGRRRLQCAKMAAGDYSVLYQDVNQISIRLEKMDFSEVMAVHRMFVRMDDLDVSSGTGLLSGAEKVKRLYVFADVVELPSKQLRLPGTDLIVILCRIFVTNGRHSTELFLPSMNMSMVAPGTGSIRGVILSPTTVLTTSSDALQFKLQSGSMTSVMRLKDVSVAATLTCNVQAASASMPLTVKTTGTSPGNICVLGMSTAVVVPESAVAVITDANILLGMQVTVLIAELVKIAHNSDVLIAAVTRHVEWLNHLLVQAHAAAPSEDVVALLYRTQGFIKLRNEGLIVPRLQYRMYKDLIDRMVQVAQSYDQDFKQLKLFVEQNKILGSYLLEQNKAFAEKEKDMDAFHSQVIDLRTSELESTIERMDDLSKQMEEQNAAMEQAKADMDAGLIAYQNKQVANAVFAVLGAIASIGLAFATGGATAPGAVASAGAAVTAAGKAAEGLKKVVEILEGLQAVMEVVAVIKELVQSLQEIGQLVDAPEMPDLPSDAEWEIFVNEVEAVAEQMPTEVTEVPAWKAKCKNVAALGREMSTMAAHIAELQFEIQVQEMLREIAKKQADRLSSIKPADLTNYLEMVSEMDMRTTRMLLELIRVLYIQNAALQYEYLQTPAPLNAWPVTMQTVWGLLVQQETAAINGLLQMGAPSDYTQEYAVRDVPVRLLLGGGDWEFELPVRNADFPLTWCRVRIRYVDMRFDAAAEHLPVTSTGEVYMLLQSSRFFEDRAKRENEFISYEGGMGLQYQYAYRLATGDATVTNVPSEEYANTFMRLAPFTRWRLRLSASAPENKGLAFPTATLADATTRIKITFHVSAIRRISTRVAV

SEQ ID NO: 803 - protein, 850 aa, Asplenium australasicum
MASFPDYREIYKNVNQVTRAVASRQGSEVMSIHRMYFKLDELEVERLTEADTVKELVVFADVVGIEGQQVKLPASRTVTIVCHILHVKQEAVKLRFDSFGPVDCDRGWLPGIGEAALILSNSPQVRLSIYAQQVVCNTTRAVVQVAHPVTVSQTVSPHNPSRYAIPGTMKWQVEIASDQPDLSAAERSYELRTERFWDVMEKVWRIDQQEWSLFTHLLQGPVSIPPAILGDSNIILGMQSTLLIAELVLSYQTRADDTVSAANAHLQWLITNLLQVLDDNSLDKETREQLLALQARAELASKLPLDGSHTLIVPRLEYGQYQGLIKSMAAVAEAYNSEFMAVNLFIQQNEILGSYLLQQNKAFAARERDMDTFHGLALARKQQELRTAQESMEDLNAQLTQQTEAMDQAKRDMDAGLKKYRDEQVAKAFFSVLKGVLAIGAAIFTGGAAAGPAVNAGVDAVKGVSSLAGKLDMVIDIMERMEKVMEVLNAVNDLVTALSEINKMVEAPEMPSVPSTYEWDIFENEMEEVAESMPTEVTEARTWKTKCKNVAAVCRAICNTASYIGQLQYDVFVQSNQALIAGKQAERLEAIQPADLTNFLEMATQMDMRTSRMLLNLLKVMTIQNAALLFHFLLPPVPFTGWVTVDMVRNALVKHEADALAARERLGPSTDFVQTYVMSDIPISLLLDGDDWIFTIDPADGSTFPLSWSRVRIQYLEMKFTGGEEFHKPTTSSGRVYILLQASRNFQDRLHGDVLHFEAAVPLRYQYAYDLQSGETTVSNRPSQQHDGEYMQMTPFGQWRLRLSASAVENQGLAFPTAVATDLDSSTTQISITFHLTAVRRIDTRALVEL

SEQ ID NO: 804 - protein, 850 aa, Asplenium nidus; identical to SEQ ID NO: 803

SEQ ID NO: 805 - protein, 886 aa, Athyrium filix-femina
MEYSALYGDVNQVSLRFEKTEFSEVVVVHRMHVRLAELNVTLGDNNILLQGSDRVKRLYVLADVVELPPIFSTSMSLPGTVSVVILCRILYLPYLEDASSASGWAVHAALLRLRVVETHAGFAQVFTIPANDSSAAAPADIGLYIHADRIIYRDDPGRSIPVIEVRVGGDSRFSPFLPGSPEIRLSSVQYVREFSKGQPVAPEDSELQRSDEIELIAPSGSEQQLRAAFGASVGMNLLFHFSSSFDILSLDPVPAALLTDPNIITGMQMNMLIAELVLTAAHNSPQLIKVVTRHVEWLNKMFLQLASPNDDILALLFRVQAYQKMAKQPHPVVPRMRYSRYEGLINQMVQIAQSYDQDLKQLKLFVAQNEILGSYLLEQNKAFAAKEKSMSEFHLQVSDLRRSELNDAIQKMTGLGEEMEVEKEAMDQAYKDMEQGLQEYEKRQIVTAVFAVISAISLCALGFVTGGATVAAVPGAVANAAQAVSAAVSLANKLQKVMGILEIINQVVQTAVAIKEVIELFDNMGQLLEAPEMPEMPSNYDWLIFVNEVEAMAEQLPVEVNERIVWKAKCKNVAVLGQEMCTTGSHIADLQYQIKVEEMLREIAQSQAERLEGISSADLSSYTEMVSQIDMRTTRLLFQLIKVLHIQNAALKYEYLYAADEHLVSWPVSMETVWTMLLQQQRLSLLGWENLVGTNNLPNDDTRTYVVKDIPVEVLLSGRDWPFVIHEEDYTAFPSGWYYVRINHVELKFEQQTAGSTDIVIHQPSTNTGRLYMLLQSSRFFHDRNQGVKMEYEGSRGLSYPYAYNLNTGETTHNNIPSDQFKNIFMQMTPFTTWRLRLSASAEENEGLVFHPPPTSPTSTTQVSITFHVTRIRRIDRSTVHQKHVS

SEQ ID NO: 806 - protein, 849 aa, Athyrium filix-femina
PTCQSPEERRGGEATVRIRGRGGNGGPERAASGVEPSHHIVPSPQDKAKWCSDPTVVLEPGGLLGEAPKQRYNGYRARGHCAADRQVLESDAKEWRACSKRPSNTGNTDIEMEDTVLQIDKYWEVTPKSGELAANGRVVTILASHLVAPVGAQLRVQCPVNVEYQTNVIWPPVFSTIAGTVEWRILPYSAVAAAVHSSAAATTSTFAGTAGLIWTVDEVKKWYPSFKIVLPEVIPLQLLANSNIVLGIEVTTLVSELIMTYQRQATETVAATLHHVEWLDAQLLSASQAQSSGQIQALHFRVQSLLKLPMDDDNAPLVVPPLQYEVYDNLINLMTRAAESYDNAFTQLNLFMQQNEILGNFLLEQNKAFSAKERDMESHHSQLVSLQDAELTATSENIKSMNNELAQQNQAMDKAKADMEAGIKQYRDRLIAEAVFGVLTAIAQVCLAVFTGGASAAGAVETARKLSETAKVLQSVVKHLERLQKIAQVINAVTDFLLNLQSLNQLIELPKMPDLPSEADWDMFENEIVAVAESMPTEISEVPMWKAKCKNVAAVGREIIRTVAYMQQLQYDLAVNKMLQDIAQQQAARLEGLHIQDLDNYMEMATELDMRTNRLLMGLLKVLSLQTGALSYHFLLPPRQLNGWLNMDTVWNALLNNEYDAVKALGSLGSAPTDTMKTYVVRDIPVGLLLEGNDWFFDIPVDDPAFPPPWFRIPIEHVELKFPTDSSQCVHLPTTHSGQVYILLQAARFFSDRLKDEVLHFQATKPVSYQYAYRLDSGETTLSNRPTLSSSTHYMRMTPFTRWRLRLSASASQNQGLAFPTAATEDATTQITINFHLTAIHQIQYRAAQ

SEQ ID NO: 807 - protein, 513 aa, Athyrium filix-femina
TGKHHTENGTIEFTNGDTKRRHGPSQRGHGCRYKSFTARLLNLDDHLASLLHTYGRGIHVPSSGLVYTHFNLQLISCRTMICIKHAGLRRFQNRRVAEAMFAVLGATAAIGLAFVTGGATAPAAVTAAGNAVNAAGQAANALRKVVEILEGLQEVMAMVALIKELVDSLQDIGQLVEAPEMPVLPSEADWLIFENNVEEVAEGMPTEVSEVSAWKTRCKNVAVLGRAMVSTAAYISQLQYDIKVEAMRQEIAKRHAERLLAIQPADLSSYTALLTHMDMRNTRMLLALIRVLHIQNAALMYHSLSLPTHMNAWPVTMDTVWRMLVQHEHAAILGLLRLGPSFDFMRTYVVKDIPVSLLRDGEDCEFNISVQDDTAFPSTWSRVRIHHLEMKFVQEAHVHQPSTHTGKVYILLQGSRIFHDRNEDDVLHYEAAMPLDLHYAYRLDTGETTLSNLPSNDFIRTFIRTTPFTTWRLRLSASAEENKGLDFPTALTVDATTQIAITFYVSAIRRISL

SEQ ID NO: 808 - protein, 882 aa, Athyrium filix-femina
LLDPVLSATEVVDYEALYSEVNEIARALWTLKVRCSEVMAINRMFVRLDTLSVEHLQQPEIVKSLIVVADVVEIEGSSSLTLPGSSLILITCRLLRVKQKNAVLNLAWNLAATNANTSTTSLPRCSIYTQQVDVSNGSTLRIQVKRELKWSNGSPFTQYFGREFSYSSSTKNYSTTSAPAAADYSVKSVGQPPESNLILVNSKKMNILMNDIAWKGFIDLQVAMPSLNDLAHPNVIEGIESNLLIVEMILTYQTNVKDLVTAAKDHVEWINKGILEVVDWPNSEVGLQLKALLGRAQMLLKMPSDGSESLIVPQLEYSGYEKVIQEMAKLAESYNTEFRELNALILNSEVIGQNILNQTKILGAKEREVQNLESLIVLRKQKELDQAIERLEILENQLIRQVDEMEAAKKKLDQGLQAYKNEQIAMAFFSVLGTMMQIAGSARLSSIPEIVVGIGGGISEALSAAEKVKDAIVSNTLQDVANKLRNVERVMEVVNSVKDLYTNATNLEDILNAPQIPDVPSSDWEIMRNDMEEVAAGMPTEVSEVSTWQAKSKNVVAVCEEICVTATSISNTQCDLFVHVEQQEIAKRQAERLNQMQAVDLGDYLEMATQLDMCTMRVLICLLKMLGIQNGALQYQYLLAPQPFIGWPTIENVRMEMLRRVELAVLAKVQLGPPVTLTRNYVIESIPVGLLMSGDDWNFSIDASDNSIFPSTWSQVRIRYLEMKFTGEHHPITETGEVYLLLQASSKFEDRLKTQMFQYEAAAPLTYQYAYNLQTGETTLPNLPHEEGTFLRMTPFTRWRLRLSASAYQNQGLSFPTTTSLDNSISISITFHLTAIVQIQTRLAGGSVYNLFDDDDGDDDQQEGGEQAGGKSGGEEEAGSPI

SEQ ID NO: 809 - protein, 821 aa, Athyrium filix-femina
MAAAVDYESIYKNANEIARVVGTDKISCSEVMACHRMFVRLDTLSVEQLVGSSNVKQLIVFADVVEIQDSSFTLPGSTQIFIACRILDVKANKDIDLTLDWQVVNNAGQTSIPRCAIYAQNIVSSSSTKSGTILLKVKYQRSSSSAPVYFGREFSYSAASTAVVDFSTAQDNLELINRKNWVVNINGMEWSAYVDLQFGLPSVEELAEYNILTGLQSTILISEMILNYRTDLPDTVTAAIAHVQWANLCLLPVVGMTNLEGAYQLPSLLGRAQSLLKLPTDGSQSLIVPRLEYSGYEKLIAQMVTVVESYNNEFVQLILFIQQNQIMGAYLLEQNKAFAAKEKDIAELESMILDRKKQEMDNAFQKMEALNKQLEQQVEDMNQAKEDMDVGIQKYKDEQVAKAFFAVIKGILGVALAIATGGATSAGAVAGAVDAVEKVSQLAKALQKVMDILQGLEELAAILSAIKELLESIEDLNKMVEAPEMPEMPTMADWDIFENEIEAVAEQMPEEVAEVPVWKAKCKNVAAVCREISTTAAYIGQLEYDLFLHGKQQEIAEAQAKRLESITPANLTNYLEMATQLDMRTTRLLVGLLKMLTVQNGALQYHYLLPPKPFTGWPTMDRIRSTLVQNEHNAVLALEQLGFSTDFTRTYVLSDVSVYLLLSGEYWIFNIPVDDPTFPSNWSRVRIVYLEINFTGDEGSTHFPSTNTGEVYFLLQASRMFQDRLEGEYLQYEAATPLQYQYAYVLQTGETTVPNKPSQEEDGRFLRMTPFTSWRLRLSASADENKGLSFPSANALDSTTQISITFYLTAIRKINTREGIE

SEQ ID NO: 810 - protein, 882 aa, Blechnum cartilagineum
MEYSTLYGDVNQVSLRFQKTEFSEVMVVHRMYVRLAELDMTTEPYFEMIAGSEKVKRLYLLADVVELPSSALNMRLPATISVIILCRILYIPDINSPYLACGLHFPLMRLRVVETSEGVGRAFPLPSNDGSGAAASIGLYIHAHRFIYRQDTTTGDSIQPLQLRAIGGSTFSTQVRPDWPETLEVSSLICWLSLTKGPRLTPADSDLQRSDEIELLAPASPDKVNIVFAGLAPGNLLSLYLLVDNTSAFSFFPTPVPNVPADVLTDPSIILGMQMNMLIAELVLAAHNSQQVINVVTKHVEWLNKILLQVASPSDDILALLFRVQAFMKMAKQPRSVVPRLQYHMYSSLINRMVQVAQYYDQEFKQLKLFIAQNEILGSYLLEQNKAFAAKEKDMSVFHSQVVSMRRSELNSAVEMMDKLSLQMEKENEAMNEAKDAMVEAIEEYERKQLANALFAVLGAIASVALAFATGGATAPGAVAAAGAAVTAAGKLAAGLQKVVEILEGLQAVMEIVAAIKDLVESLQNMGQLIDAPEMPELPTNADWQIFVNEVEAVAEQIPTEVAEVPVWKAKCKNVAVLGQEMCTTAAHIGELQYQVMVEEMLQEIAQRQADRLEGISPTDLSSYTEMASQIDMRTTRVLLSLIRVLYIQNAAIKYEHLFAASGQLDSWPVSMETVWTMLLQQENAALLGLLDLGPSNDFTVTYVVKDIPVQLLIDGADWNFEIPVGDFTAFPAGWSRVRIRYVELKFVQQGSGEGNIVIHQPSTNTGLVYILLQSSRFFHDRKREEVMDYEASMGLAYAYAYDLVTGATTLSNIPSEEYANTYMRMTPFNNWRLRLSASAMENQGLVFPTATSPDSTTQIAITFYVTAIRRIDTRIDTQRQE

SEQ ID NO: 811 - protein, 865 aa, Blechnum cartilagineum
WPCVGGSRAQPSVSAGENHVMGNASSTDYEHIYRNANNISRMVATPVCSEVMSVARMFVRLRDLDASRLKNPEVVKELYVVADVVDMEEYNDLTLPGSERIYLICRVFTWRRNQPPPTTVRIRTPWLNLSSCSKLEICPLRHDRQAQTSPAFQCFARAKHSTTSEIAPAVLFLHAAHIYTSNPDTDTSHLNVVLQAQESAQYTLMSADQTPSGEEIFWEVETYPLLPRSDLNSTILSAQEANVLVIELILSYITHATETVKQASLHLEWLNKLLNYALNDTSSASTGSLDDEALDRQLHNLSFQVQFLLNQPPTGAGLIVPRLQYYAYSNLVGTMARIAENYDKEFRQFSLFIEQNDVLGTYLLQQNKAFAEKEREMEVFHLELQQVKKDDLTRALAKLERLEVDMREMNAAMEQAERDMEADLVQYRNRQVARAVFSVIGAIAQLGLAFFTGGATAGGAVAGVANAVSQVTDSAALASLRRISETLEKLVLVTEFLVAMRDLLNAVMDIHQGPPEVPTLPEMVSEAEWAIFENEIEAVAAGMPAEVSSVLTWKTKCKNVAALGREMITLATIIVDLQHDIKVHGLMREMAQNHAQRLKALQPVDLKNYQEMATELDMRTTRMLLGLLEVLSLQNAALRYQYLLPPSPVTIESTSLTMSTAWTLLLQHESASVISLADLGFATDQEVAYIVKGIPVGLLLDGEDWDFPISVRDIAEGAAFPADWSRVRISHVEMKFVKPGAAPADEEETVHQPTTNTGKVHMLLRGEQLFADRKRGESLKYEAAVSMEYQYAYRLDTGETTQSNRPSQEFGDKLFMQMTPFTRWKLRLPTAANENRGLAFPTASAENATTQITISFHVSAIRTIF

SEQ ID NO: 812 - protein, 842 aa, Blechnum cartilagineum
SVFCRYQIHLLCVELRFGSCLLAGSIQHLSMGNSIAAAEARNYEEIYKDANHIGTKSLITAVCSEVMTVCRMYVLLDDLDVKVLERAEEVKVLYVVADVVELRGDAVQLPPSVQLILSCRVLLFSSGNGWPQVAILQGPLVHYNGNYSPVTGNWSATPLLEQDTYRFFLHGQQLLILSGTSGRSSGDVLSEDGKKLQLQSSTAPILPPRWVMEDPHILSGLEASVITSELIVGHMTHAVDLVAEVKLHVEWLLLLLRHALNETMTNAEANHLLRSLFFRVQSLVRMATAAQNNTLVVPRLQHHAYSEYINRLAELARSYDTDFKALTLFIQQNEILGSYLLEQNKAFAEKERDMEVVYTTLNDIKMSELIQALGQLERLGEEMGKMSAEMEQAREDMEEGLKIYRNKQVARAAFSLLNAIAQIGLAIFTAGATTGLAASAVANAGQAITQATEAVQQLRRIFETIEKMLLLAEVLVAMRDLITAMNDGGELGTLPEWPEMPTTAEWEIFENEIEAVAAGMPEEVSETLVWKAKCKNVAAIGREMVTQAMLVSQLEYDIKVHSLLQEVAQNQAARLEAIQPTDLIDYQEMAAQLDMRTSRILLSLLQVLALQNGALTYSYLMPRTSLSARSVSATMSAVWGLLLHQGQATLVALGELGSPSTRSVEYVVKGIPVGLLLDGEDWDFTIPVADTLHFPSTWSRVRISHVEMKFVKTGGTAGRDEELQVHQPTTHTGEVYIVLRSELFFQDRRKGQYLKYEATVPVIYHYAYNLATSETTEDNRPDEEFARVFMRMTPFTRWKLRVSTSARENQGLAFPTAITPDATTQIAIRFYLSAIRDFDWNH

SEQ ID NO: 813 - protein, 845 aa, Blechnum cartilagineum
MGNASSTDYEHIYRNANNISRMVATPVCSEVMSVARMFVRLRDLDASRLKNPEVVKELYVVADVVDMEEYNDLTLPGSERIYLICRVFTWRRNQPPPTTVRIRTPWLNLSSCSKLEICPLRHDRQAQTSPAFQCFARAKHSTTSEIAPAVLFLHAAHIYTSNPDTDTSHLNVVLQAQESAQYTLMSADQTPSGEEIFWEVETYPLLPRSDLNSTILSAQEANVLVIELILSYITHATETVKQASLHLEWLNKLLNYALNDTSSASTGSLDDEALDRQLHNLSFQVQFLLNQPPTGAGLIVPRLQYYAYSNLVGTMARIAENYDKEFRQFSLFIEQNDVLGTYLLQQNKAFAEKEREMEVFHLELQQVKKDDLTRALAKLERLEVDMREMNAAMEQAERDMEADLVQYRNRQVARAVFSVIGAIAQLGLAFFTGGATAGGAVAGVANAVSQVTDSAALASLRRISETLEKLVLVTEFLVAMRDLLNAVMDIHQGPPEVPTLPEMVSEAEWAIFENEIEAVAAGMPAEVSSVLTWKTKCKNVAALGREMITLATIIVDLQHDIKVHGLMREMAQNHAQRLKALQPVDLKNYQEMATELDMRTTRMLLGLLEVLSLQNAALRYQYLLPPSPVTIESTSLTMSTAWTLLLQHESASVISLADLGFATDQEVAYIVKGIPVGLLLDGEDWDFPISVRDIAEGAAFPADWSRVRISHVEMKFVKPGAAPADEEETVHQPTTNTGKVHMLLRGEQLFADRKRGESLKYEAAVSMEYQYAYRLDTGETTQSNRPSQEFGDKLFMQMTPFTRWKLRLPTAANENRGLAFPTASAENATTQITISFHVSAIRTIF

SEQ ID NO: 814 - protein, 812 aa, Blechnum cartilagineum
MGNSIAAAEARNYEEIYKDANHIGTKSLITAVCSEVMTVCRMYVLLDDLDVKVLERAEEVKVLYVVADVVELRGDAVQLPPSVQLILSCRVLLFSSGNGWPQVAILQGPLVHYNGNYSPVTGNWSATPLLEQDTYRFFLHGQQLLILSGTSGRSSGDVLSEDGKKLQLQSSTAPILPPRWVMEDPHILSGLEASVITSELIVGHMTHAVDLVAEVKLHVEWLLLLLRHALNETMTNAEANHLLRSLFFRVQSLVRMATAAQNNTLVVPRLQHHAYSEYINRLAELARSYDTDFKALTLFIQQNEILGSYLLEQNKAFAEKERDMEVVYTTLNDIKMSELIQALGQLERLGEEMGKMSAEMEQAREDMEEGLKIYRNKQVARAAFSLLNAIAQIGLAIFTAGATTGLAASAVANAGQAITQATEAVQQLRRIFETIEKMLLLAEVLVAMRDLITAMNDGGELGTLPEWPEMPTTAEWEIFENEIEAVAAGMPEEVSETLVWKAKCKNVAAIGREMVTQAMLVSQLEYDIKVHSLLQEVAQNQAARLEAIQPTDLIDYQEMAAQLDMRTSRILLSLLQVLALQNGALTYSYLMPRTSLSARSVSATMSAVWGLLLHQGQATLVALGELGSPSTRSVEYVVKGIPVGLLLDGEDWDFTIPVADTLHFPSTWSRVRISHVEMKFVKTGGTAGRDEELQVHQPTTHTGEVYIVLRSELFFQDRRKGQYLKYEATVPVIYHYAYNLATSETTEDNRPDEEFARVFMRMTPFTRWKLRVSTSARENQGLAFPTAITPDATTQIAIRFYLSAIRDFDWNH

SEQ ID NO: 815 - protein, 817 aa, Blechnum cartilagineum
MAAGKTVPMYNHDNQSATIWAEGEMVWAERETSDLLCVNWPYILLDDLGVSRISNPSAIRHVVVIADVVEIDQPLVSLPGSLSITLVCRILRVRQAAGAVLQLRHLQAEWATLSQGQSAQLHLYAQQLVGSLEVHQPVMHTIEPEIPETGLPPIGPPFPPIIASSYMIWAISPYTNASQSKPASLTLHGIVVTHSDEWHNRFKVIVPHSPPLEAFEGVDILLAIEAGLAVAETILTFQTHARERVEAARRHAQWLNQLLQELLDSGRSLKEQILGQLFRTQVLLKLPVDRSQTDAVPRLQYERYGSLINRIAREAESYITEFKKMSLVMQQLDQTARGRQLLAMMETFAANESAMEVEETIYLEDAAVLETRRKIWKRQLEKLQAEMEQANQDMNEGLTGYNDRIDANAMFAILKAVASIGLAMFTGGATVEVAVAEAAVAVSLVSGTNAGRLQNAIKTLQVLVGVIEVLVALNSYFSQGQIEQIQNARAMPQLPSEAEWSSFEDDIEAVAATMPKEASEVPTWKAKCKNMAVFCRELTSTASDLALLRSNMRVHDIRKDIAMIYMERLPQMNPAENFKDYAQLVALLDVQNSRILLRLLDMFVLQNGALGYEYLFPVTRLISGWPKVENLSTMLARSEAEAADYLLTEVGQQTNFSATYAVPEIPVGLLQNHDDWIFTIPINGSIVLSDRWSRIRIHNVDIRFRQGALQPSTVDDQLHILLEAAPTFRDRRKQDILDFKAVVPASYTFAYHLRTGETMPTPEVSDQYPLMKMTPFTQWRLRLSDQNHGLAFPTALSPHDTTVISLTLFFSRIVTDW

SEQ ID NO: 816 - protein, 507 aa, Blechnum Gibbum
VCRALISCIQKKIGKTRSLVVPQLQYDVYSSLINRMAQSAESYDQSLRQFKLFIEQNKILGSYLLQQNKAFADKERDMDNFYSELISQIRKVELQSTILRMDQLSLQMQTQSEDMEKAKDDMDKGLRQFQERQVANAMFATIHALASITLAFVTGGATAPGAVAAAGNAVREAGQLARALEKVVGILDGLQVVMEVVSIMKDLVTSLQDLGQLVEAPEMPDLPLQSDWFIFENSIEEVAAEMPTEVSEVTAWKTKCKNVAVLGRKMITTATYISQLQYDIMVQGMLQEISKSHGDRLASIQAADLQSYTAMVTQMDMRTTRMLVALIKVVYMQNAALMYQSLSPPTYVNAWPVTMETVWSILLQHDHAAVLGLMRLGPSFDFMRTYVVKDIPVSLRRDGEDWEFNIPVKDYTSFPSTWSRVRIHHLEMKFVTEGVNGAAHVHQPITDTGSIYVLLQGSRIFHDRNEGEPIDYEANLPSQEFTKTFMRMTPFTNWRLRLSASAEENKG

SEQ ID NO: 817 - protein, 851 aa, Bolbitis cladorrhizans
MASLPDYYEIYKNVNQVSRPVASRQASEVTSIHRMYFKLNLLEVALLTKADEVKELVVFADVVEMEGGKVELPASRIVTIVCRILSLKREDVELGFKFLGPVECEEGWQVGLNSEMAYIRRTSPQVRLSIYAQEVVHNSTGAILRVTHPVTVRQRVSPHRPSQYTPGTMKWQINISSAHADLSTAQRSHELRTQRFWSEPERTWLINPQEWSPFTFFLPPGLLPLAILGDSNIMLGMQSTLLIAELVLSYQTHAQATVSAAHRHLQWLTTNLVQVLDDDSLENEIREQLLALLARAELASKLPLDGSQNLIVPRLEYGQYRGLISSMAAVAEAYNSEFTAVNLFIQQNEILGSYLLQQNKAFAAREKDMEAFHGLVVERKRQELSSAQETMEELNVQLTQQTEAMDQAKEDMEAGLKKYRDAQAARAFFAVMKGVLEIGAAIFTGGATMGLAVQGGINAVKAVSSLAGKLDMVLQIMEGMEKVMEVLNAIDDLVAAVSEINKMVEAPEMPSMPSTHEWDIFENEIEEVAESMPEEVTEARTWRTKCRNVAAVCRAISTTASYIGQLQYELFVHSNQELIARRQAERLEAIQPADLTNSLEMATQLDMRTSRMLLNLLKVLTLQSGALQFHFLLPPTPFTGWVNMGMVRNALVKHEADAVAAQERLGPSTDYVRTYVMSGIPVSLLLDGDDWIFTINPLDGSTFPLSWSRVRIRYLEMKFTGGEEFHKPTTDSGKVYMLLQASRNFQDRLRREVLHYEAAVPLQYQYAYHLTTGETTVENRPSQQHHGEYMQMTPFGQWRLRLSASAFENRNLAFPTAANTDLDAATTQISITFFVTAVRAVDFRSLDDQDM

SEQ ID NO: 818 - protein, 406 aa, Bolbitis cladorrhizans
WCSRCIFFFTGGATAGAAVAQATRAAQSVIKLTTALKKVMDIVEKLQEVMEVISAINTLWNSLQELNNIVEAPKMPELPTEADWDIYENSIEEVAASMPTEVTEVQAWKCKNVAAVSREMTKTAVYVGQLQQMILVTGLQQDIARKQAERLESMQPQDLSNYQEQATLIDMRTSRILLALLDVLILQNGALRYECLLPPEPITGWPTMDDVRRILITQEGLIVNSHTILGPSYNLEVGYNVSGIPVDLLLDNDEFQFTIPISDRVFPLSYFKVRVRYLEIRFVNDSGNHQPTTLTGEVFISLQASRSFKDREKSGGELQYEAAVPKIYQYAYNLSTGQTTFTTEPAAGTENTYMQMTPFASWRIRLSKSAHENEGLKFPTASQGDTTRIFIRFFLTIIRKVERKHQ

SEQ ID NO: 819 - protein, 895 aa, Campyloneurum angustifolium
SSARAAGVFSSMAVATLRAAEYRELYKDLNQVSEGLILEMMEFSEVMVIHRMYLRMVELDVGHLEGAEKVKHLYVFADVVEMAPASSTVRLPGSVSVSIVCRVLWLPVPVSNIPLIAFPHLKLRANFASGSGNRQFNVYRRTDGGSEVDEGLALCIHAVDIQLTGVPAFAVNSPAFYLFTDPRNLTMPAEGAITFGDPDRQVPVLMFRMYAEAQRLSGVNTGIIRISPPFSNNLRIATTVHAPPTVTLLTIDTHHPHGPGFWILRGIPDSLLKSDQLMLLMQMSLLIAELAELAHPSSETRAAVLEHVEWLSGVLIDGASSTEGTQMHQEYLELLFRAQYLLKTTSSSRSLVVPQLQYALYSPLINRMAQVAQIYDDAVNQFKLFIAQNRILGSYLLEQNKASAERERDLEVFHAELISQMTIELNSTLLKMDQLSLQMEAQTADMEQAEREMEEGLRRFRNRQVARAIFSVFRAIAAVALTVVTGGAAAPAAMNAARGAVSVAGQAARGLQSVLEILEGLQVVMEVVAIIKELVESLQDLGKLVEAPDMPEMPTDADWAIFVNEVEAVAAEMPEEVSEVVTWKTKCKNVAAVGRELMTTAAYISRLQYDIKEHSMLQEIAKRHANRLANTQAANLSSYTEMVIQMEMRTMRIIISLVKVVYVQNAALMYQYLSQPTQMRQTWPVSMETVWRMLTQREHASVLGLIRLGPSFDFERIYVVRDIPVSLLLTGEDWEFEIPVSDETTFPSSWTRVRIKHLEMKFVHDDGSAAAGHHQPITDTGKVYILLQSSRVFHDRDQAGREPLSYEAALPLDYQYAYHLDTGETTLSNLPTTQFINTYMTMTPFTNWRLRLSASALENQGLDFPTARQQGAVNQDATTQIAITFHVSAIRQISF

SEQ ID NO: 820 - protein, 764 aa, Campyloneurum angustifolium
MADYATIYANANQIYRRGVVMEGSRVMSVQRPYVLLDELDMQKLKNANVVQNLVVVADVAEIQASQLSLPGTNQVLIFCRILQVRSANRILITVAAQATQVQIGAQITQNLEVKWPDGSNFLNSWPVWRGNVLSGDYGSNNFDLQTFLTGADILLGIQATLLIMETILTFQTQLRETVEAASQYAEWLSTLVPHERFATQEIKDQLIPLVYRSQTLAKMPLDGSQTTVVPRLRYDSYRNLVNALAQTAAQYDNDFKDLERFIQTQQLLDARLLEWNKNFIAKERDMESFHSQVLYLKQDEMKSALDKVDRLGKQHQELTDEMNTAKEEMDKGIRRYQNAQIASAFFDVVAAIGAVVATFFTGGATAGVAVERATKAAQSVISLTTALKKVMEVVEKLQEVMELLSAMKTLWDSVQEINNITEAPKMPELPTEADWDIYENNVEEVAASMPTEVTEVQAWKYKCKNVAAVSREITRTAVYVGQLQHEILMNTMQQEIANKQAARLEAMQPQDLSNYQEQVTLIDMRTSRVLLALLNVLVLQNGALRYECLLPPEALTSWPTMDAVRRILITQEGLIVNSQSSLGPPRDYEVTYNLSSIPVDLILDNDDFQFTIPTSNLTFPMSYFKVRIRYLDIQFVNEIGSHRPTTLGGEVFISLQASRTFQDRDKSAHELQYEAGVPNTYQYAYNISTGITTLSTKPAVGTENVYMQMTPFSRWRLRLNRSAHENNGLKFPTATSQGDTTRIFIKFYLTVIRKIETRAGTLST

SEQ ID NO: 821 - protein, 940 aa, Campyloneurum angustifolium
SSARAAGVFSSMAVATLRAAEYRELYKDLNQVSEGLILEMMEFSEVMVIHRMYLRMVELDVGHLEGAEKVKHLYVFADVVEMAPASSTVRLPGSVSVSIVCRVLWLPVHISDIPLIAFPHLKLRVILPRGPVGVVFNQFAVFRRTDGGSEVDEGLALCIHAVDIQLTGVPAFAVNSPAFYLFTDPRNLTMPAEGAITFGDLDRQVPVLMFRMYAEAFAVNSPAFYLFTDPRNLTMPAEGAITFGDLDRQVPVLMFRMYAEAQRLSGVNTGIIRISPPFSNNLRIATTVHAPPTVTLLTIDTHHPHGPGFWILRGIPDSLLKSDQLMLLMQMSLLIAELAELAHPSSETRAAVLEHVEWLSGVLIDGASSTEGTQMHQEYLELLFRAQYLLKTTSSSRSLVVPQLQYALYSPLINRMAQVAQIYDDAVNQFKLFIAQNRILGSYLLEQNKASAERERDLEVFHAELISQMTIELNSTLLKMDQLSLQMEAQTADMEQAEREMEEGLRRFRNRQVARAIFSVFRAIAAVALTVVTGGAAAPAAMNAARGAVSVAGQAARGLQSVLEILEGLQVVMEVVAIIKELVESLQDLGKLVEAPDMPEMPTDADWAIFVNEVEAVAAEMPEEVSEVVTWKTKCKNVAAVGRELMTTAAYISRLQYDIKEHSMLQEIAKRHANRLANTQAANLSSYTEMVIQMEMRTMRIIISLVKVVYVQNAALMYQYLSQPTQMRQTWPVSMETVWRMLTQREHASVLGLIRLGPSFDFERIYVVRDIPVSLLLTGEDWEFEIPVSDETTFPSSWTRVRIKHLEMKFVHDDGSAAAGHHQPITDTGKVYILLQSSRVFHDRDQAGREPLSYEAALPLDYQYAYHLDTGETTLSNLPTTQFINTMTPFTNWRLRLSASALENQGLDFPTARQQGAVNQDATTQIAITFHVSAIRQISF

SEQ ID NO: 822 - protein, 861 aa, Campyloneurum angustifolium
MASTTKAAGDWRELYRDMHQVSDRMRFDQLEASEVMVIHRMHIKLSELDMGNLEGGEKVKQLYVFADVIEYDHGVPGASRIVRLLGSVSVVLICREWHMSCQLVANVDHYEITGRDDGLRIVLPHMTLHVVSTYSIPGRTNRIDPQSMQEFPEPCFQVYAEDLSMSFYAPAGGNSWDPALRFPGGGHFQAINNVDLVTHNAFVSFLTSAGIVTETTRHSTLRIYQWDQAGLHNMYNRIGSQPPGTRFIVPRYTEARTDVWAGGNRVIARVEVRLLPAYIVLGLRNLVPVQLLINPNILLTMQSSMLIGELVEATNPSAATREIVLKHVKWLNNLFLQVIEEKKGKDVEEYIALSFRAQYVIKRVGRIHGLVVPQLQYDAYSNLINRMAQVAESYDQAIRQFRLFIQNTENNKILGGFLLEQNQAFAEKEKDMDVFYSELIAQRQIELGNTLQKLERLSVQMQQAHADMQQAEADMEAGLRRFQNRQVAKAVFSVLGAIAAVALTIVTAGAAAPVAIGAAKNAVTVAGSAARGLIRVLEILEGLQAVMEVVRIVKDLFDALQELGQAVELPDMPDMPLQSDWLIFVNEVEAVAEGMPVEVSEVVAWKTKCKNVAVLGQEMTTSAAYISQLQYDIMMQDMLQQIARRQAERLSVLQLSDVTNFTEMVVQMDMRTTRLLVALIRVVDIQNAALMYQYLSTPTPVSTWPVSMDSVWRMLLQHEQHAIQGLMRLGPSVDIVRTYEVKGIPVSLLLDGDDYEFELSAEDRTPFPLSLSRVRIHHMEMKFVQGAHVHMPTTGTGTIYILLQGSRNFHDRNEGKIVHYEGATSLDYHYAYHLDTSETIITNMPSAEFVRTFMRMTPFTN

SEQ ID NO: 823 - protein, 424 aa, Campyloneurum angustifolium
FATGGATAPAAVSAAEAAVTAAGKGAKGLQAVVDILESLQEVMEVVSAIKELVESLEQIGQLVDAPEMPDLPSNADWEIFVNEVEAVAEQMPTEVTEVVAWKAKCKNVAALGREMSKMAAHIAQMQYQIRVQELLREIAQKHADRLSSIKPADLTNYLEMVSEMDMRTTRLLLELIRVLNIQNAALQYQYLKTPAPLNAWPVAMSTVWGLLMQQETEAIAGLLELGAASDFTREYVVKDIPVRLLQEGQDWEFEIPVSSADFPSTWCRVRISHVAMQFDAGAAATHVPTTKSGEVYMLLQSSRFFDDRAKRANEFISYQTGMGLFYQYAYRLTTGEATVTNIPSDESANTFLRLTPFTRWRLRLSSSADENIGLAFPTATSADATTQIKITFHVSAVRRRNIFIADLTSNTDQFSLNVKKSCVP

SEQ ID NO: 824 - protein, 557 aa, Colysis wrightii
DGEATAVCTRFVVPRLQYHMYGSLINRMVQVAQNYDQEFKQLKLFIAQNEILGSYLLQQNKAFAEREKEMSAFHSQVVSMRRSELTTAIETMNQLSLQMETESEAMNEAQENMVEAIQEYERKLLARALFSVIGAIASVALAVATGGATAPGAVAAARGAVTAAGRLAQGLQKVVDILQGLQAVMEVVVAIRDIVESLKNMGQLVEAPEMPEMPTDADWLIFVNEVEAVAEQVPTEVAEVPVWKAKCKNVAVLGQAMCTTAAYMSELQYQITVEEMLQEIAQRQADRLVGISAADLSSYTEMASQIDMRTTRILLELIKMLYIQNAAIKYEYLYDANEKLNSWPVSMETVWTMLLRQENAALLGLLNLGPSNDFTVTYAVKDIPVKLLVDGYDWNFEIAVEDFSIFPSGWSRVRIRYVELKFDQQGTDSSNIVIHQPSTNTGLVYMLLQGSRFLHDRKREEVMDYEASMGAVFAYAYDLNTGATTLSNIPSQQHANTFMQMTPFNAAWRLRLSASAMENQGLVFPTATSPDNTTQISITFYVTAIRRIDHRQEGDEE

SEQ ID NO: 825 - protein, 946 aa, Coniogramme japonica
MDAATDHDYDYESDMHDEESPDLEHLARKVEMVDVADDDDESGMTIVHGESTEQLARGTRSVDFGAEDYRDLNQVSERIRLDQMEFSEVMVIHRMFIRMVELDLGHLEGAEKVKRLYVFADVVEVAEGVAWGLWRNGPLARLPGSIAIVIVCRVLWVSGVLASLGNNSMMLQLPHMKLRVLEITPSKLEIHRVDTSTEAADYPALCIHASVLECSNIRLANDRDRPPFPVRLFGFRPDLRDPNLVFSSVPRSVVDHHPINEFYVFSVIRDVFPRLPLPESVSVQLDSATRGANWYSLQTGSISQVGSVSLNRFPAEEEELEPAFSLMKTKIPAAILTDPNILLTIQTSLLIAELVEVTHPSAETGAAVAKHAEWVNELLLQAASEASGTPSHEEYLALLFRSQYLIKVRGRTRSLVVPQLQYDVYSNLINRMAQVAESFDQSLRQVKLFILQNKILGSYLLEQNRALAEKERDMDVFHSELISQSKLELENTIQKMEQLSSQMETQREGMDQAKEDMDAGLRSFQNRRVAEAMFAVISATAAIGLAFVTGGATAPAAVTAAGNAVRAAGQAANALQRVVEILEGLQEVMAMVALIKELVDSLQDIGQLVEAPEMPVLPSEAEWFIFENNVEEVAEGMPTEVSEVSSWKTRCKNVAVLGRAMVSTAAYISQLQYDIKVEAMRQEISKRHSERLLAIQPADLSSYTSLLTHMDMRNTRMLLALIRVLHIQNAALMYHSLSLPTHMNAWPVTMDTVWSMLVQHEHAAILGLLRLGPSFDFMRTYVVKDIPVSLLRDGEDCEFNISVQDHSAFPSTWSRVRIHHLEMKFVQEAHVHQPSTHTGKVYILLQGSRIFHDRNEDDVLHYEAAMPLDLHYAYRLDTGETTLSNLPSNDFIRTFIRTTPFTTWRLRLSASAEENEGLDFPTALTADATTQIAITFYVSAIRRISL

SEQ ID NO: 826 - protein, 1004 aa, Coniogramme japonica
MSGTPARLSLPALIISLSLTLTYRQVPDMDAATDHDYDYESDMHDDLVLRRLKLMHQVPDMDAATDHDYDYESDMHDEESPDLEHLARKVEMVDVADDDDESGMTIVHGESTEQLARGTRSVDFGAEDYRDLNQVSERIRLDQMEFSEVMVIHRMHIKLSELDLGHLEGAEKVKHLYVFADVVEVDEGESGELPVRFPGSMSVFILCRIWHVRAFVGLDGRNHHRVLRLPHMTLHLYRSPTLTRLHRLDPTTLQDVAEPALSIYADVVQVSLQNRPATVHSIAPFYFESSDSRVLLSRPNQQRLLQRTSLFWVRLFRNGIPNPGLPAITNEAFSVRIEDRQVLSGRGPFPTTRYSPAFPRGLLTPDIPVIFLTDSHILPALQTSVLIAELVELGRPSQATIDAVASHLRWLNKLLLKVIQETKGSTEFRQDEYLELSFRAQYLIKKMGNIRSLVVPQLQYSVYSPLINRMAQVAESYDQSLTQFRLFIQQNRILGSFLLEQNRAFAQRERDMDAFHSELISERETELENTLDKMLQLHSQMERESAEMERARERMEEALIDFQRRTILRAVFSIFAAVAGLALAFVTAGAAAPAAVAGASAAVSAVSNTVTVAAALQRIVGMLEILETVMEVVRLIKEIIDNMDLVDQLADAPEMPEMPSDHQWLIFMNDVEAVAAEIPPGVSGVSAWKARCRNVAVLGREMITTAGFISQLQYEIKVQTMLQEIAKRQAERLLAIQLPSLTNFTEMVTQMDMRTTRILVTLIKVVEVQNAALMYQYLSEPTLVNAWPVTMDTLWRILVQHEHSAIRGLIRLGPSFDINRNYVVRGIPVDLLMHGEDWQFEIPVLPNDDDDDEMDAIFPSSWSRVRIHHLEMKFVKAPHVHQPTTRTGSIYILLQGSRIFEDRNQGARVHYEAATSLDYHYAYRLDTGETTLSNFPSMEFTQTFMRMTPFTTWRLRLSASARENAGLTFPTAITADSTDQLIDPDATTEIAITFSISAIRHISF

SEQ ID NO: 827 - protein, 774 aa, Coniogramme japonica
SAVPRCSIHAQQVVVSRTAPPPLLSSIGSLIIRVKRDLQRSDKSPFTQYIVRYFSYSGANTVVTAPVSPTRPPSFHWLQIVSTQRRVTVMFNEIKWNKWKADIDFQVALPLLDDLTDIHVIKGIESTLLIVELILTYRSDRMDTVAAALEHLQWINKSLVEVVQLPNSERVLELKALAARAQMLLKLPIDGSHSLKVPQLQYGQYNDVIDQMAVVAEAYNSEFRALDLFIQGNQIIGDYMLTQMKLMSTKEKDVADLESLMVLRKEQELKDAMERLQFSEEQLLKQVEEMTEAQRQMEQGVMEYVNRLTANAFFAVLGASMNIVGSLMSGSIGGVVGGIGGTISEARDIISMMDDAVASRSLLNVANGLIEVERVFEVVNAIHELYKTASSLEDLLVAEEMPIIPASEWDIMENNMEAVAATMPTDVSEALVWKAKCKNVMAVCREICTSAVTLTELQYDLFVHARKQEIAQRHADRLAEFTAADLSEYMEMASQVDTQNMRVLISLLSMLAVQNGALQYNYLMPPEPFTGWPTVESVRSALVRRKHQAVIRKASMGASHELPAHTYVLQSVPVGLLLSGEDYIFTIDPSGSDFESTWSRVRILHLEIKFTGEHQPRGGPREQAYFLLQPSSHFQDRWGNQVFHYEAVVPLIYQYAYNLNTGQTTLPNIPHEEATFLRMTPFTRWRLRLSASASQNQGISFPTATAPDSTTQITITFYVSAHVRPQTFNPLDHAEEPDIPWGEDQQQRSTEPEHEEPERGEEQEQPDIIPQEPV

SEQ ID NO: 828 - protein, 641 aa, Coniogramme japonica
SAVPRCSIHAQQVVVSRTAPPPLLSSIGSLIIRVKRDLQRSDKSPFTQYIVRYFSYSGANTVVTAPVSPTRPPSFHWLQIVSTQRRVTVMFNEIKWKADIDFQVALPLLDDLTDIHVIKGIESTLLIVELILTYRSDRMDTVAAALEHLQWINKSLVEVVQLPNSERVLELKALAARAQMLLKLPIDGSHSLKVPQLQYGQYNDVIDQMAVVAEAYNSEFRALDLFIQGNQIIGDYMLTQMKLMSTKEKDVADLESLMVLRKEQELKDAMERLQFSEEQLLKQVEEMTEAQRQMEQGVMEYVNRLTANAFFAVLGASMNIVGSLMSGSIGGVVGGIGGTISEARDIISMMDDAVASRSLLNVANGLIEVERVFEVVNAIHELYKTASSLEDLLVAEEMPIIPASEWDIMENNMEAVAATMPTDVSEALVWKAKCKNVIAVCRELCSTAVSMSELQYDLFVHASMQEIAQRQAERLEEFRASDLGEVTEMATQVDMQTMRVLLSLLSTLAIQNGALQYNYLMVSEPFTGWPTVENVRSSLVRRQQQAIWDRPPSCRPTRTCWSRYRWACFSLGRITCLLSTQAALISRIPGLASASSTLRSSSLEDTCHAQLATKPISYCKRRPNSRIDGGRRSSITRQLLP

SEQ ID NO: 829 - protein, 882 aa, Davallia fejeensis
MEYSSLYGDVNQVSLRFQKTEFSEDMVVHRMHVRLEELDISVGPFNNETIEGSENVKRLYVLADVVELPSTPRNTRLPATISAIILCRVLYIPDIRFAHPTTCGLDFPFMRLRVVETSQGVGQAFALPSDDDGTGSTGAAASNIGLYILADRFIYRQATSTANFVQPLRLMTYGTSSFSTTVRPDWPEALNISPLTYWLTLSKGPPLTSSDSDLQRSDEIELLARPPPPDRIQVVFRPLAPGNMGGMALLLENSSSAFSFFPAPAPAVSADVLTDPSIILGMQLNMLIAELVLAAHNSPQVIKVVTKHVEWLNKILLQVASPSDDILALLFRVQAFMKMAKRPRFVVPRLQYHMYSSLINRMVQVAQSYDQEFRQLRLFIAQNEILGSYLLEQNKAFAEKEKEMSVFHSQVVSMRRSELNSTIEVMDRLSSQMESESEAMDKAKDNMVEAIQEYERKQLANALFAVLGAIASVALAFATGGATAPAAVAAAGAAVNAAGRLAQGLQKVVEILEGLQAVMEIVAAIRDLVESLENMGQLVAAPEMPEMPTNADWLIFVNEVEAVAEQIPTEVTEVSVWKAKCKNVAVLGQEMCTTAAHISELQYQITVDQADRLVGISIADLSSYTEMASQIDMRTTRMLLELIKMLYIQNAAIRFEYLYAASEQLNSWPVSMQSVWTMLLQQESASLLGLLDLGPSNDFTVTYVVKDIPVKLLVDGYDWHFEIPVDDFASFPAGWSRVRIRYVELTFDQQGTDQSNIVIHQPSTNTGLVYMLLQGSRFLHDRKRGELMHYEASMGLSYAYAYDLNTGATTLTNIPSEAHANTFMQTTPFTAWRLRLSASAMENQGLVFPTATSPDDTTQISITFYVTAIRRIDTRQSGDHVE

SEQ ID NO: 830 - protein, 855 aa, Davallia fejeensis
MERAIPDYSHMYRELNQVSERMKIEEMELSEVMVIHRMFIKLPDLSIAHLEGADKVKRLYVFADVVEFGSVGQTSSLPGSIMVVIMCRVLTWHWADALATPYQLDFPHMRLHAIVRSENGPLLHYHRRNSDSVHDDYPVITVSAHVIQFSGSRPTHFFGIGPLRDPSMIISSVVHQPNIVERPSRGSFCNVGLSSGSSIVTNPGRVQFRIILNWDVDRSYTVTRAPQGFSLLQRDLPDLLLIDPNILLCMQTSMLVAELVEFSHPSSDLHAAVSEHVAWLNTHLLQASTKAQGTSSHDDYLALIFLAQYLLKGMGRARSFVVPQLQYDVYRNLINQMARVAESYDQSLRQLQLFVAQNKILGRYLLEQNRAFAAKERDMEVFHSELIANKELELQNTMFKMEQLSLQMETQIADMDQAREDMDAGLRRFRNRQVANAMFAVFRAIGAIALTVVTAGAAAPAAMAAAKGAVTIAGQAARGLVRVLEILDNLQAAMEVFKIIKDLVESLREVGQLVDAPDMPDMPTEADWSIFVNEIEGVAEEMPEEVSEVSAWKTSCKNVAAVGRELMTTSAYISQLQYDIKVQALLQDIANRQAERLSSIQAADLSSFTEMVTQMDMRTTRILIELIKVLDMQNAALMYQSLTPPAPMNAWPVTMETVWGMLVQHEHAAVFGLMRLGPAFDFKRTFIVKEIPVDLLLHGEDWQFEIPVNELTVFPSTWSQVRIHHLEMKFVGTHDIEGAHQPTSESGEVYILLQGSRVFHDRNKSEPLHYEAAVPLDYHYAYHLETGETTLSNSPSNDFIRTFMRMTPFTTWRLRVSASAKENQGLAFPTTTVGAGDTTQIAVTFYVSAIREISL

SEQ ID NO: 831 - protein, 867 aa, Davallia fejeensis
MELIEKERTNKMVYTSAMVDYERLYREVNQTARAVGINKVRCGEMMAIHRMFVKLDSLTVENLDQYEVVKGLVVIADVVEIEGSSELTLPGSEYVLIFCRILHVKTDKEVVLNLNWKLSHNPPPSPSPRCSFYAQEIVASPNATLLIQVKHNDKWSNDSTFTQCIGRRFSYSSTNSSISSTPPSNVSSLGNPPTSNLILVEFERMNILYNDTNWRAFIRFQVSIPSSYDLLFPNVVEGFESTLLIVEMILSYQTDNRDLVHAAQQHLHWVDKLLLEVVSFGGDAHVQTQNKALLSRAQMLLKMPLDGSQSLVVPQLEYTGYEQVIRDMANMADAYNREFQALNQFIISNQITGQYMLNQNKALAERENDIQALESLIVLRKEQELDQAMRRLELLENNVRRQANEMDAAKDRLDQAIQDASHKRFATAYFALLGATFQIVGSLNVSNVPGIVVGIGGGINDLVNAANEVNDLTQRNMLRDVANKLGNVERVVEVVNAVQDLYKNATSLEDILNAPEMPIILASEWDSMENDVVELAAFMPTEVSIEVSTWTAKCKNVMSTSREICTTAVSISQIQCDLFVHAKQLEIAQRHAERLEEMQAVDLGDFLEMAMQMDMRTTRFLINLFRKLAIQNGALQYHYLLPPRPFTSWPTIDNVRRELVLRAEMSVLAQEQLGPPIRLTRTYAVHSIPVGLLLSGDDWNFLIDPSDDSTFPSNWSQVRIRYLEMEVTGEHKPITQSGEVYLLLQASSMFQDRLRGQIFHYEAAAPLSYAYAYNLATGETTLPNQPHEEGRFLRMTPFTRWRLRLSATAPENQGLSFPTATDLASSTQISITFYVTAIVGIHNLSSTVLSLLDYNEHGEEDHEEAKV

SEQ ID NO: 832 - protein, 340 aa, Didymochlaena truncatula
MPTEADWAIFVNEIEGVAAGMPEEVSEVSAWTTKCKNVAVLGRELTTTAAYISRLQYDITEHAMLQEIAQRHANRLSTIQAADLSSYMEMVMQMEMRTTRIMVSLIKVISIQNAALMYQCLAPPKELVRQWPLRMETIWTMLMQNEHVAILGLIRLGPSFDFKRTYVVRDIPVSLLLAGEDWEFEIPVSDHTTIPSTWSRVRIQHLEMKFVDDDATGAHQPITDTGKVYILLQGSRAFHDRSQLGLLPLLYEAALPLDYHYAYRLHTGETTLSNLPSTNFMDTFMRMTPFTNWRLRLSASAEENQGLDFPTARQQGTINEAATTQIAITFHVSAIRQISF

SEQ ID NO: 833 - protein, 863 aa, Dryopteris erythrosora
MEYSDLYGDVNQVSLRFQNTEFSEVMVVHRMHVRLDELHIPLTALEGSKKVKRLYVLADVVELPSSRPSLLLDLPATISVIILCRVLYAPATLTFLNFSFLQLRLRVVETSEGVAQTFAVPSEDDGDGSNIGVYIHADRLISRQLDTTTNNRLLLVMEVVGAGSTFSSTVRPNWPDTINVSVLGWELLLSRGPALTPSDSDLQRSDEIELLANPPHFPSELHGSVRFESWNPAVNTMHLFLQFQNSSTFSFFPVPAPPHVPADVLTHPSIILGMQMNMLIAELVLAAHNSPPVVNVVTKHVEWLNKILLQVASPTDDILALLFRVQAFMKMAKQPRFVVPRLQYHMYSSLINRMVQVAQNYDQEFRQLRLFIAQNEILGSFLLEQNRAFAEKEKEMSVFYSQVVSMRRSELNSGIETMDRLSLQMGTESEAMDEAKDDMVEAIQEYERKQLANALFAVLGAIASVALAFATGGATAPGALAQGLQKVVEILEGLQAVMEIVAAIRDLVESLENMGQLVAAPEMPEMPTNADWLIFVNEVEAVAEQIPTEVTEVSVWKAKCKNVAVLGQEMCTTAAHISELQYQITVEEMLQEIAQRQADRLVGISIADLSSYTEMASQIDMRTTRMLLELIKMLYIQNAAIKYEHLFAASGQLNSWPVSMQTVWSMLLQQESAALLGLLDLGPSNDFIVPHVVKDIPVKLLVDGNDWHFEIPVEDFAIFPAGWSRVRIRYVELKFEQQGTIHQPSTNTGLVYMLLQGSRFLHDRKREEVMEYEASMGVSYAYAYDLRTGATTLTNIPSEASANTFMQMTPFTAWRLRLSASAMENQGLVFPTATSPDDTTQISITFYVTAIRRIDTRQQGDVE

SEQ ID NO: 834 - protein, 818 aa, Elaphoglossum
RLLKSNRTSTCCAPTGVWELLTCWRQSILSMAKDYAEIYKGTSQLDRSVATPVCSEVMTVARMYLLLDDLDVSLLKQPEVVKTLYVFADVIEMKKRVTLPGLEAFIVCRVFLTFTTTEETRSIWPELQTGVIVCRVFLTFNTTETRSIWPDLETDGPGWVPPDPSDPRPPAEPAPVQVPVYPILTDGTILHPLTAANAVPRSTLENSNMLLAMQATLLISEVILSFMTHATDLFTEATLHVEFLNNLLVKGMEDTTSGSGEEGRHQLRTLLFRVESLLKMQAPGLLVPRLHYNSYRNLINRMADMAMSYDTEFKQLNLYIQQNEVLGTYLLEQNKALAEKEKEMEEVHSELQEYKTTELRDVLATLDRLGGQMSEMSAEMDQAQEDMEKGLIVYQNRQTARAVFSVLNAIAQIGLAFLTGGATAPLAVNAAANAAQSASKLLKVVETLERLLLTVELLVALRDLFDAINNLGSEMTGTPIKPEDMPSAAEWTIFENEIEAVAAEMPVEVSEVLAWKAKCKNMAALGRELVNQTALVSQLQYEINLHSLQREVAQNHADRLLAIQPVDLSNYQEMAIQLEMRTTRILLGLLQVLLLQNGAIHHYYLQAPTPLSSTSVTMTAVRTLLVRQEATAVISLAELGTPSDRNFTYSVKGIPTKVLLDGEDWDFAVPVTDRDVFASDWNRVRILHVELKFVTADSGEVHLPTTDTGEVYMLLRSERFFEDRKNDELLQYEATLPVQYQYAYNLKTGETTEDNRPSEAFANLFMQITPFTRWKLRLSASASENRGLAFPTAVAADATTQIDIRFFVSAIRRIDWKM

SEQ ID NO: 835 - protein, 788 aa, Elaphoglossum
MAKDYAEIYKGTSQLDRSVATPVCSEVMTVARMYLLLDDLDVSLLKQPEVVKTLYVFADVIEMKKRVTLPGLEAFIVCRVFLTFTTTEETRSIWPELQTGVIVCRVFLTFNTTETRSIWPDLETDGPGWVPPDPSDPRPPAEPAPVQVPVYPILTDGTILHPLTAANAVPRSTLENSNMLLAMQATLLISEVILSFMTHATDLFTEATLHVEFLNNLLVKGMEDTTSGSGEEGRHQLRTLLFRVESLLKMQAPGLLVPRLHYNSYRNLINRMADMAMSYDTEFKQLNLYIQQNEVLGTYLLEQNKALAEKEKEMEEVHSELQEYKTTELRDVLATLDRLGGQMSEMSAEMDQAQEDMEKGLIVYQNRQTARAVFSVLNAIAQIGLAFLTGGATAPLAVNAAANAAQSASKLLKVVETLERLLLTVELLVALRDLFDAINNLGSEMTGTPIKPEDMPSAAEWTIFENEIEAVAAEMPVEVSEVLAWKAKCKNMAALGRELVNQTALVSQLQYEINLHSLQREVAQNHADRLLAIQPVDLSNYQEMAIQLEMRTTRILLGLLQVLLLQNGAIHHYYLQAPTPLSSTSVTMTAVRTLLVRQEATAVISLAELGTPSDRNFTYSVKGIPTKVLLDGEDWDFAVPVTDRDVFASDWNRVRILHVELKFVTADSGEVHLPTTDTGEVYMLLRSERFFEDRKNDELLQYEATLPVQYQYAYNLKTGETTEDNRPSEAFANLFMQITPFTRWKLRLSASASENRGLAFPTAVAADATTQIDIRFFVSAIRRIDWKM

SEQ ID NO: 836 - protein, 591 aa, Elaphoglossum
DNRDIAWKHLHSWPEYSCRCSTSMPLAVKTTGTSPGNICILGLSTAAIVPESAVAVITDANILLGMQVTVLIAELVKTAHNSDIVIDAITRHVEWLNHLLVQAHSTAPSEDVVALLYRTQGVLKMPREGLVVPRLQYHMYKNLIDRMVQVARSYDQDFRQLRLFVEQNRILGSYLLEQNRAFAAKEQDMDAFHTQVIALRTTELNNTIETMDLLSIQMEAENEAMEQARADMEAGLVQYQNRQVANALFSVLTAIASIALAFATGGATAPGAVSAAGAAVTAAGQAAAGLRRVVEILEGLQVVMEVVAAIKELVQSLQEIGNLVDAPAMPDLPVMEVVATIKELVQSLQEIGNLVDAPAMPDLPSNADWDIFVNEVEAVAEQMPTEVSEVPAWKAKCKNVAALGREMSTMAAHIAELQFEIQVQEMLRDIAQKQAERLLSIQPADLTNYLEMVSQMDMRTTRMVMELVRVLRIQNAALQYEYLQTPAPLNAWPVTMETVWGLLIQQETAAILGLLQLGPPSDFRREFEVKDIPVSLLLEGQDWEFELPVMNADFPTTWCRVRIDHVEMHFDSAAAHLPTTNTGKVYMLHCQ

SEQ ID NO: 837 - protein, 1344 aa, Polystichum polyblepharum
MGDEGDVKEDEYDYEAAYKEIDDCIRKDECFGRVENCGGLWGQTMVVRSMYLRLDDIDARHVVRPETVETLLVYADVVDVESDWVDLPGTKLVFIHCRLMRLKSRGGSTTVHFKYMMATAREGSPITYLYPHQLIVAGGDQASGLILRVSYRIQVLKKQVELVRTCHLNTFKSITVQTLKTPGFTYNSDESDFEAARTRIDLFEADYSFSEDLCNKIRYLLTTSLSSLQNTLPKICVIPPVACLHLEWLTHDCVLLWLLIREQNLKNLREKKNLVITPELKNSLLITIIKLSRMGEVAFTELVREGLIDDKHKGDLKFIFQTMHNLHRILKIQRTRTIGEVANYDEVFNSVNQIKEVVATRECSEVMVIQQMYLLLDDINVGLLQNPHNVKKLVVFADVIEIRSQNLHIPSSREVIIICRILRTKRANKLTFPYLSYNSYPLSLYVSPFGLLQQDSTSKVCIYTKELIMNDPANLLRVYSTSMELPNLVEVLGDPYVLPLIVDSLQSVENIMTYLKRTTVIATIVQDHLQWLISLLNQMMFAKSGNINITGLWRQWAENLSSHIEDATQHTLSTSEVVDYAEVYKNVNADYTELYKSVNQMRRVFVGGECPEVVIVHRMYLRLDELAASLFKKPYAIKELYVYADVVELGSQNLQIPGSTKIIIICRILRVKGPHKLTFPYLSHDPNSLPLSLFVSMINLMDWTSTLGVCIYAQHLIMNNPFNPTKCSSTSFELSIPVLIQLGNPNVLPLIEGDLQSAELILTNQTSVTATVTATKDHLQWLITILNEAKDITNLSKVSFRDLLNHAQSILRKSNESSILLVPSLRYDKYSDLIKTMANAALDYDNEFKQLDLFNKQIQISGDYLWVQNKKLAEKERDVALFHLSLLEHKKKELNAAKENSSKLKEQLKSLKKELVKAQQDLDAGLKRYRDELKMKAILSVTFLVINLALVFSTFGGNINGYKEVQESIEECKSTKKILVETWKVIKTLQEVALCLGENIGNSTKRKLHDTFDMPKMPSKADWYKFENEIVEMVENLPSKMSEVFAWKAKCKNVAIVSRELITTMAYIRRLEQEIWVEDREVEIATKQAERLEKMKVVGLNNYEDMVFQLDIRTMRILTQLLRVLNLQNGALLYHYLLQPKPIVKRWMNMGEVTSALRSHKELEIEGLEQMGTPTDKESVYKVCNIPVDLLMDGQDWIFTIPTDDFLVFPRSWSHVRIKYVEIRFSPTHHIPSTTSGQVYFLLQASRMFQDRKKEQVLDYEAAVPLEYQFAYDLKSSKTTESNKPTHEYEGSFMRMTPFTQWRLRLSSSAEENQGMSFPTAKEPDSTTEISITFYLTSIREKST

SEQ ID NO: 838 - protein, 1031 aa, Cyrtomium falcatum
MCVQEVIFDTMHNLHRILKIERTRTIGEVENYDEVFNSMNQVREVVSTTECSEVMVVQQMYLLLDDLNVGLLQNPHKVKKLIVFADVIEIGSQNLHIPSSAKVTIICRILRTKRPKKLNFPYLCHNSSPLSLYVSPFGLLQQGSTSKVCIYTKELIMNDPFNPLRVYSTSMELPNLVEVLGDPYVLPLIVDSLQSIYYILTCQKSTAIIATTTQDHLQWLISLLNQMFAKSGNNIIDFWRQWAEYLSKHIEDVTQHTLITSRMVDYAQVYKNVNADYAEVYKSVNQMRRVVAMQGRECPEVVTMHRMYFLLDELNASLFKNPDAIKELYVYADVVELGSQNLQIPGSTQIIIICRILRVKGPHKLTFPYLSHDHDISPLSLFVSTVTLFDWPSTLGVCIYAQHLIMNNPFNPFTFASTCFQLSIPAELLGNSNVLPLIEADLQSAELILTYQTSVTTTITATKDHLQWLITLLTKVKDDADLNEVSFQDLLNHAQSILRKSYGSTTLLVPSLRYDKYSDLIKTMANAASAYDSEFKQLDLFNKQIQIAGDYLWVQNKKLAEKERDVTLFHSSLLEHKKKELNAANENSEKLKKQLESLKTELMEAQQDLDAGLKRYKDDLKMKSILSMVFLVINLALVFTTFGANINGYKEVQESIEGCKEIKKVLVETWKVIKTLHELTLCLFEKIGTSTKRKFHDAFDMSKLPSIADWYKFENEIVAVVENLPSKVSEVFVWKAKYKNVAVVSRELITTMAYIRRLEHEIWVEGREVEIARKQAERLEKMKVVGLKNHEEMALQLDMQTMRILTHLIRVLNLQNGALLYHYLLQPRPIVERWVNMGEVTSALRSHKELELEGLEQMGTPTDKESVYKVGNIPVDLLTTGQDWIFTIPIDDFSAFPQSWSHVRIKYVEIRFSPTHHIPCTTSGQVYFLLQASRMFKDRKKGAVLDYEAAIPLEYQFAYDLKSGKTTESNKPTHEYEGSFMRMTPFTQWRLRLSTSAEENQGLSFPTSKETDSTTEISITFYLTSIREKST

SEQ ID NO: 839 - protein, 1348 aa, Matteuccia struthiopteris
MGDKYVGDKEEEYDYEAAYKEIDDCLRKDESYGRVENYGGLWGETMVVRSMYLRLDDIDARHLVSPERVKTLLVYADVVDVESQWVDLPGTCILIVCRLMRMKARGGSTTLNFKYVMASGSDGHVFTGGLFPPQQLIVAGRGEASGQEQQLVVRYSFRIQVLRKEVDVVRTILWTPYTDITSLRTTRQTLKKPGFTYKSDESDFEEAQTRVELLASEAKGEDLSEVCTLGHDLSKSTCNKVRFLLRTSLSSLQNALPKICVIPPAACLHLEWLTHDCLVLWALIRDQSDRQELRGMQSLIHIATLMRNMGGLGAFTGLIGYKHKPDLKVIFETMHNLHRILKIERTRIIGEVANYDEVFNSMNQIREVVATSEVMVMQRMYLLLDDLNVGILQKTKNVQTLVIFADVIEIGSQNVQIPGSTKVTIICRILRSKRPKMITFPYLCHNSSPLSLYVSPFGLLQQDSTSKVCIYAKELIMNDPFNPLRVYSTSVELSNHVEVLGNPDVLPLIVKSLQSVDYILTYQKSTTIIATTTQDHLQWLISLLNQVMSAKIGNSVIDFWRQWAEDRSKYIEDVAEHTLSTSKVVDYAEVYKTVNADYAEVYRSVNQMRTVVFNTDIECSEVMIVHRMYFLLDELNASLFKSPDVVKELYVYADVVELGSQNLQIPGSTKIIIICRLLRVKGPRTITFPYLSHDHDLSPLSLFVSIVNWPSTLGVCIYAQHLIMNNPFNPTTCSSTSFQLPIPVEILSNPNVLPLIEADLQSAELILTYQTSVTETITATKDHLQWLITILNEAKDHTNINEVSFRDLLNHAQSIFRKSNGSTILLVPSLRYDKYSDLIKSMANAASAYDSEFKQLDLSNKQIQIVGDYLWVQNKKLAEKERDVARFHSSLLEDKNKELNAANENSEKLKEQLESLKIELMKAQQDLDAGLERHKDKLKMKAIQSVVFLLINLALAFTTLGVDIKAYAEVQKSLKKYKDTKKILEDTWSLINMVARSLCVCEKIETSTKIQLHDTFDMSKMPSKAHWYKFENEIVAVVENLPSEVSEVFVWKAKCKNVAVLSRELITTMAYIRQLEHEIWVEKREVEIARKQAKRLEKMKVVGLKNYEEMALQLDMRTMRILTHLLRLLSLQNGALLYHYLLQPRPIVETWMRMCEVTSALRSHKELELEGLQEMGAPTDKESVYKVGNIPVALLMTGQDWIFTIPTDDFKVFPRSWSHVRIKYVEIRFSPEHHTPSTTSGQVYFLLQASRMFQDRKKGQVLDYEAAVPLEYQFAYDLKSGRTTESNKPSHEYEGSFMRMTPFTQWRLRLSTSAEENRGLSFSTAKETDNTTEISITFYLTAIREKNT

SEQ ID NO: 840 - protein, 1082 aa, Thelypteris noveboracensis
MGENVEDNEYHYDYEAAYKEIDDLISTVVKRECSEEIMVVHCMYLRLDDVDAGHLVNPEKVKIMLVYADVVDVESEWLEFSGRFEVYIMCRMLRVKARHGSTLDFKYFTPIGASMKTLQLPAWTMNEQLHIWAQQLMGGENEQELAIRAGFWAYEENTRVQVVGELRVKPYGRECTEDESVTRTCQTLQKPGFTYRPDESDFQEAQSEVNDLLCNRPRWFKECFHLVSPEPIAISWSDELCETIEGALSSLELALSRACIIPSAAFLHLQWLVRHLAQMGSTATMSSIASANINCLESLLSRAKTLLNAITYLQAHTRIIGEVVYAEVYKNMRRAFSTRECSEVMTMQRMYFLLDDLDMGLFKNPHVVKELIVYADIVEVGSNTLWIPGSTRVIIMCRLLSLKRSQPCILNFPHMPHDDASSYLSVYVSPAMLLNQPPATLGVYIYAQELIISNPINPTTCFSTSFQSSIPVEILGDCNVLPLIQGALHTLTYQLSATANVKTTQDHIQWLIIHLAQVENKANLHESSLNDMRDLLLHAQLLLKMSSESKSVIVPSLRYEKYSKLIERMATAASDYNSQFLQVDYFIRQNQISGDYLLQQNKIFMEKERDVEYFHSLLTDCKKVEFDAAMHKMKALKELLTTQEVEMNQAKKDMEAGLKRYQDSKIADAVFSLFGAVFEVGLAASALANAGTTLRRFKDVVEKMKKLKDTLEEIVKMVKMVENICSSFDALMDVYTLDFQKPQQIGKSLMPEMPKMPSKADWEIFENELMQVAESMPSEVSEVPIWKAKCKNVAAVFRELITIVSYMKQLEFDILVEGMEGKIAAKQMERLEHMTLADLKNYEDMAMQLEMRTSRILSRLLKALNVQSGALLYHYLLRPKPITNWMDMDAVTNALLSYEELAVEGLEQLGTPTDYRREYVVADIPVALLMDGQDWTFTIPIDDYLVFPAYWSAVRIKYVEMRFDEGHHLPSTNSGQVYCLLQASRMFQDRKRGEVLDYEAAIPLDYQFAYQLETGCPTVTNKPTHEYMGTFMRMTPFTQWRLRLSASARENHGLTFSTAREANSTTQISITFYLTAIREKSL

SEQ ID NO: 841 - protein, 874 aa, Pteris cretica
MFTQDDDWCVYMYCSPGILDMAGRDHNTDVINYEEIYKAVDEVRRTVVPRSKDAVMIVEGMYVNLNSRIDDGLFTGDSSKPKEVWVVADVVALSNDVKVPTSTERLVILCRILHVDGSYARLFSASQNVILDCDYIQESEAISKSWKVRSTELQIHIYAQCLQAPSSKELMPLCVSIPAHRKYPFFIYVMWGLFGMFDSGRGRMMPALSFPRHENNFLGPLFRSREELEQLERLFVVSLCDEQIPAALLSEAAIVEAMQATLLKAELILTYQTQAHGGATAEMARQHVEWLRSQLKGCISSQQEGQVQLDAGLAALLVRAESLSKMPQRTAYNVVPSLTYKAYRDLINRLATAAKDYDNSFMQMRTLVQSSQMTDSDFETLYKALAQKEKDVDEYHQQLARLKQNELKEVSSSLDVLKCELEKQKQAMDEAEQDANDRLKEYEMKQAAKAVFEVVKAVFAMGAAVFTAGTTVGVALEGVEEAVNASGKMKQALELLEKINKLLKVMAAIQKLIDSLNHLKDVIEAPELPSMPTEADWDIFENEIMAVASQLEKAINVANWEAKCKNVAAVGKEFIKTANRMGQLQYEILVQNLQGEVARRHRERLEEIISKGRDYDKYEEIARHVEMLRSNLHIRLLHILDLQRAAVYYHFLLDQTPFTVWVDVDTVTATLIDNEAVILTNLDSLSKCSDKTITYSVEGIPVSLLESGGAWVFSIAVPGSDQSGHKGFKDLSRVRIEYMTIKFAANSAKPQTHDDDDTDDDTVLFLMQAATDFQDRRKADKKVLQYEAAVPLRYRYAYNFSTEEELVDNRPSTSGGVEDFWMRMTPFTTWRLSLPISDPYNEGLKFDDSSASTTTSIRIVFHVSAIRDESYLFR

SEQ ID NO: 842 - protein, 819 aa, Cyrtomium fortunei
KLWKSRKVLGGGGGMVVRSMYLRLDDIDARHLVSPERVENLLVFADVVDVESDWVELPGTKTVLMVCRLMRLKARGGGSTTLDCRLRLATDQVDAGGGVYPPQQLIVAGEASGLLVRCSYRIQVLEKEVDVVRTCHLSPYTDVMAGLIVTMQTLKTPGFTYNCDESDFEAAQTRVVVLEERAMPERTCNSVCFLLRTSLSSLQNALPKICVIPHPAARLHLEWVTHSCLPLWLLIRGQYLHEKKDLVITNELQAQILTYIVKLIRMGEVAFTKLVQEGLIGYKLKGDLKVIFETMHNLHRILKIERTRTIGEVANYDEVFNSMNQVREVVSTTECSELMVVQQMYLLLDDLNVRLLQNPHKVKKLVVFADVIEIDSQNLQIPSSAKVTIICRILRTKRPKKLNFPYLYHNSSPLSLYVSPFGLLQQGSISKVCIYTKELIMNDPFNPLGVYSTSVELPNLVEVLYVLPLIIDSLQSIYYILTCQKSTAIISTTTQDHLQWLISLLNQMFAKSGNNIIDFWRQWAEDLSNHIEDVTQHTLSTSEVVDYAQVYKNVNAHYAEVYKSVNQMRRIVATQGRECLEVVTMHRMYFLLDELNASLFKNPDAIKELYVYADVVELGSQNLQIPGSTKIIIICRILRVKGPHKLTFPYLSHDRDISPLSLFVSTVRLFDWPSTLGVCIYAQHLIMNNPFNPTTCASTCFQLSIPVELLGNPNVLPLIEADLQSAELILTYQTSVTTTITATKDHLQWLITLLTEVKDDANLNEVSFRDLLNHAQSILRKSNGSTTLLVPSLRYDKYSDLIKTMANAASAYDSEFKQL

SEQ ID NO: 843 - protein, 616 aa, Colysis wrightii
RAYSANRVRPKFPLHHLSHVFLYLVYVNLNLRIVEGLFLNRGGSKPRKVWVVADMVALSNDVMVPTSTERLVILCCILHVDGSFARLFSNSQAVAVLNQNHGEVSFYNSCKVLSTELQIHIYAQCLQAPSSKELMLLCISIPVHRGSPFALNVTWGHFGMFDSHRSRMMPVLSFQYNDAKNFVGPLFRSREELEELERLFVVLLCDEQIPAALLGKAAIVEAMQATLLKAELILTYQTQAHGGATAKMARQHVKWLRSQLKGCISSQQEGQVLDAGLAALLVRAESLSKMSEQIAYNVIPSLTVIPSLTYKAYRNLINKMATTAKDYDNSFMQMWTLVQSSQMTDSDFETLYKALTQKETDVDEYHQQLARLKQKELKEVSSRLDVLKRELNKQKQAMDEAEQDANDRLKEYEMKQAAKVVFGVLMAVFAIGAAVFTAGATVGVAMKSVEEAVNASGKLKQAFELLKNTNMLLKVMAAIQKLMDSLDHLKDVIEAPVLQSMPTEADWDIFENEIMAMASQLEKAINVANWKAKCKNVAVVGKEIIRTADCMGQLQYEVLVQDLQGGVARRHKKRLEEIVSKGRDYGKYEEIARHFEMLRSNLHIRLLHILDLQRLY

SEQ ID NO: 844 - protein, 580 aa, Blechnum occidentale
LNWVSCLSSTSVDGEVSKDLGALLFRVQALLKLPLSYEVVPSLEYTTYQMLIDNLARAAEAYNNEFNRVDLFIRQNQILGSYLVEENKALAEKEKDMEELHNTLVKRKQDELEATIKKVDLLQIQMAEQKRAMDKAKEDMDSGLKEYEEKEIAKAFFAVLSAIGGCVLAFATGGAAGGGAAEGVEKAAEAVKEAEKAVSLLVKLVDTFKKLMDVLKKVQKVVEAVLAIKDLIEKIVDITKMVNAPPMPDLPSNADWEIFVNEVESVAENMPKEVSEVATWKCKCKNLAAVCREITTTVVYMQQLEYDLLVESLQAKVAAKHAERLQEIKPADVKNYLEMASQMNMRTTRILLNLLKVFKLQRGALLYHYLLPPNPFTGRVTIDTVRNALVQNAADAIMAMQQLGPSNNFEREYVVCDIPVDLLMQGQDWTFTIPIDDYVNTFPSAWCRVRIQHVEIKFSSGHHQPSTNDGEVYFLLQASRTFQDRGHSGDLLNYEAGVPLYYQYAYSLKSGKTTLSNKPTQEDEGLYMRLTPFTQWRLRLSASAYENQGLSFLTAKATDPSENTQISITFHLTAIRTVSF

SEQ ID NO: 845 - protein, 902 aa, Lygodium flexuosum
MSTAEAELMTSTAYESISNGAAWSPTNHTDDVAADDDEEWQDDMISMSDYEKLAYGDHYADYEAIYSGVNQLARAVGIRNRVECGEVLAIHQMFVRLDTLSVGNLLRPERVQRLIVFADVVEIKGATLTLPGSALVLIACRLLRVENRDVELNLSWNLAASSTGTPAPRCSIRAQEVITTSSTMPVLGCTLLIQVMHALTWNNNSTFTQYFGHRFSYSSENSSSTAPPVNQFMSSPGVPPTSNLILVNSKTVNILINNMRWKGYIDFQIGLPPWDDLVEPRLIDGIESTLLIAEMILSFQTNARDTVRAAKEHVEWINKALLQVVDAPNSEARFRLKILLARVQMLLKLSMDGSPPGLVVPVLEYSRYERVIRELVRVAELYNSEFNQLNLFIQQNQILGDYVLQQSKVLAEREKDVQALESSIVARKQQELNSAIRRVELLEAQLQTLATEMDEARENMDKGLQAFRNRQIAMAFFTVLGAALQLGGSLRLSSIPEIVVGIGASISEAINVAQQVEDAVASNNLVDVATKLVDVEKVIEVVNAIKQLYENDAFLEDILDAPEIPVIPSSDWDIMENNIEEVAAGMPTEVSEVVTWKTKGKNVIAVCREICATAISISELHYELFVHGKQRDIAQRHIERLEQMQTANLGEYIEIATQVDMQTMRLLIILLGNLAIQNGALHYHYLLPPEPLISWPSIDSVRRHLIQQEEKALLAEEGMGVPVRLSRAYVVEDVPVKLLLDGGDWIFTIDPSETLGFPDTWYRVRIRYIEMKFTGENIPQNPNTGKVYLLLQASSMFQDRYEREVFHYEAATPHNYQFAYELDSGEVTLPNEPAEAGRHFLMTPFTRWRLRLSASAYQNQGVFFPGTHDDGASTNISITFHVTSIVGIQHRIAEEEETLVIN

SEQ ID NO: 846 - protein, 708 aa, Lygodium flexuosum
MAAKPVLEINVADDMDYAELYRDVNQVTRPVATRQCSEVMAVHRMYFRLDDLHVDNLQNSQVVKQLYVFADVVEVEGDSVELPGSGQVSIFCRVLKLKRSEAAIRLSMLEAVRCTGRQRRTALGQDVEYYWVTPQNRLDGAGPVVTVLAAQLVAPPGAAQLRLTYPLIVDARVYDSDGYHPDFFTSNGTMEWRISTPTNGSSNTNPERTCGARTVIRPGIQWRAFEEEWYPSFRVLVAEAIPPEMLDNSNVLLGMESTTLISELVMAYQREAKDTMAATLRHVEWLNHQLLAVNQDTHSNFQFHHKQQIQSLHFRVQSLLKLPNATDDAKTLIVPPLQYNVYSNLISLMTQAAQSYDNDFKNLNLFMQQNEILGSFLLEQNKAFAAKERDMESHHSQLVNLQEEQLVTAKTRVDRLHDQLERESQAMDEARADMEAGIREYRNRLVAQAFFAVIQAVAAVCLAAFTGGATAAGAVGSAKQLSEAAQALQSVVELLERIEQIVEMVNAVTDFLSALESLNQMIELPEMPELPSTADWDIFENEIVAVAEGMPTEISEVPVWKAKSLNVAALGREIITTVAYIQQLQYDLGVNGMLQRIAQQQAERLESLQIQDLDNYLEMATELDMRTSRMLMSLLKVLTLQTAALSYHYLLPPRPLIGWVRMDSVWNALVRNAYDAVIALSSLGPSTDFVRTYDVKEIVTFEWTRLDL

SEQ ID NO: 847 - protein, 896 aa, Lygodium flexuosum
MAGSAGAADAWREVYRDLNQVSDRIRLDQLEFSEVMVIHRMHIKMSELDLGHLEGAEKVERLYVFADVVELDVVPHESSSDGDVVVRLPGSKFVTFVCRVWHINYALVQISSFARITRSVVLELRHMRWHFNAITGRMHLLDPQTLQDGMDLCFCVHAEVVQIAYYPDVTFPESNDSPSFLRFLRLEIVPDQLRVTTQTDGPVWALRGSLDYFMTPDNDGLLNEVSSQPAGTSFVLNILPDNLDVQLYANLRPNSGTTLTRDPNSIVPAFSVYKEKAGELLSDPNILPAMQTSMLIGELVEVGQPPSVTTEVVRKHVEWLNNLLLQVIEAKRGEHVEDYVELSFRAQYVIKKVGRIQRLVVPQLQYSAYSNLINRLAQVAESYDQALRQFRLFIQQNKILGGFLLEQNRAFAEKEQDMDIFYSELIAQRQIELDSILQKMKHLGAQMETQTADMEQAQADMEAGGSVGIREFQNRQVARGLFAVLGAIAAIGLTLLTGGAAAPLAVSAARSAVSLAGAVAQGLQRVLDILEGLQVVMEVVELINGLISSLQELGQPVELPEMAEMPTEADWLIFVNEVEGVAEQMPTEVSEVVAWKTKCKNVAVLGREMTTLAAYISQLQYDINMQHMLQRIARKQADRLSAIELPDLRNYGELVTQMDMRTTRLLVALIKVVNIQNAALMYQYLSEPTPVYAWPVNMDSVWRMLVQHEQFAIQGLMRLGPAFDIVRTYEVKGIPVSLLLDGDDYEFEIPAQDHVTFPLSLSRVRIHHLEMKFVQGEGDQLHMPVTDTGSVYILLQGSRNFHDRSEGSILHYEAATSLDYHFAYRLDTGETTVTNLPSAEFLTTFMRMTPFTNWRLRVSASAEENKGLAFPTATSADATTHIAITFFISAIRQIAL

SEQ ID NO: 848 - protein, 817 aa, Marsilea mutica
MDYTKLYNDVNQVSIRLELMDFSETMVVHRMLVRLDELDVSSGTGLISGAEKVKNLYIFADVLELPSASKKVRLPGSDKIIIVCRTFVANAQSSSTDLPLTSGVKFNMETGSKSTSVGGAYASSTKSSSSTAKGLQLKIQNGSYKSTMRQGSLSASEASTLELDISTTSGIINVITLNTSPSGSICFVGMTANATPPSTVVDVITDANVLLGMEVSLQIAELVKTANNSEDLLTAVTAHVQWLNDLLLQAVDALGVDKAGEAATLLCRAQGFLKTKRPNLTVPRLQYSMYKNLIDRMVQAAQDYNQSFVQFKLYVAQQKALGSFLLEQNKAFAAKEKDMESFYTQVISLRTTELKNAISRMETLSDQMDEESEAMDKAREDMEAGLIEYQNKQLARAFFAVIGAIASIGLAFATGGATAPGAVSSAQTAVTAAGKAAEGLQKVVDILKGLEEVMALVAAIKELVESISNIGELVNAPEMPDMPTDADWDIFVNEVELVAEQMPTEVSEVPAWKAKSKNVAALGREMTTTATYISQLQFQITVDQMQLEVAQKQYDRLSSITIGDLTSYLEMVSQMDMRTTRILVQLINVLYIQNAALYYEYLLVPEQLSAWPVTMQTIWTLLIQQEVKAITGLTELGPSSDFTRSFIVQDIPLSLLKSGNDWEFEFPVSGADVFPIAWSRVRIDYIEVKFPSTARHAPSTSTGEVYILLQGSRFLDDRAKKDNEYISYEATTGVPYQYAYRLSNGETTVSNIPSQEYRNTFMRMTPFTSWRLRLSISAPENQGLDFPTSTSIGDKTQVEITFYVTAIRRISTRDQPI

SEQ ID NO: 849 - protein, 767 aa, Marsilea mutica
EGEESVHLCRCGGVTISVKESVRLPGSDKIIIVCRTFVANAQSSTTDLPLTSGINFKMETGFKFTGVGGMYITSTKSSSSTTKGLQVRIQNGSYTSTMRQGSLSASEASTLALDISSTSGIINVITLDTSLIGSICFVGMTNSAIAPSTAVDVITDANILLGMKVSLQIAELVKTAHNSEDLLAAVTTHIRWMNSLLVHAVEELGVANAGEAVALLCRTQGFLKTKRPNLIVPRLQYNMYKNLIDRMVQAAQDYNRSFLQFRLHVQQQKALGSFLLEQNKAFAAKEKDMESFYTQVISLRSTELGNAINRMENLSEQMADESAAMDKAREDMEAGLIQYQNRQVARAFFAVIGAIVSTCMAFATGGATAPGALASAQNAVTAAGDAAGGLQRVVDILQQLEEVMALVAAIKDLVDSIRNVGELVNAPEMPEMPSDADWDIFVNEVELVAEQMPTEVSEVPAWKAKSKNVAALGREMTTTATYISQLQFQITVDQMQLEVAQKQYDRLSSITIGDLTSYLEMVSQMDMRTTRILVQLINVLYIQNAALYYEYLLVPEQLSAWPVTMQTIWTLLIQQEVKAITGLTELGPSSDFTRSFIVQDIPLSLLKSGNDWEFEFPVSGADVFPIAWSRVRIDYIEVKFPSTARHAPSTSTGEVYILLQGSRFLDDRAKKDNEYISYEATTGVPYQYAYRLSNGETTVSNIPSQEYRNTFMRMTPFTSWRLRLSSSAPENEGLNFPTSTSTSDTTEVEITFYVTAIRRISTRDASI

SEQ ID NO: 850 - protein, 409 aa, Marsilea mutica
SKRGHGSRPDRVSKQAIGKSILCRDRRHSLYWSSIRHWWCNSTWRMALVAAIKELVESISNIGELVNAPEMPEMPTDADWDIFVNEVELVAEQMPTEVSEVPAWKAKSKNVAALGREMTTTATYISQLQFQITVDQMQLEVAQKQYDRLSSITIGDLTSYLEMVSQMDMRTTRILVQLINVLYIQNAALYYEYLLVPEQLSAWPVTMQTIWTLLIQQEVKAITGLTELGPSSDFTRSFIVQDIPLSLLKSGNDWEFEFPVSGADVFPIAWSRVRIDYIEVKFPSTARHAPSTSTGEVYILLQGSRFLDDRAKKDNEYISYEATTGVPYQYAYRLSNGETTVSNIPSQEYRNTFMRMTPFTSWRLRLSSSAPENEGLNFPTSTSTSDTTEVEITFYVTAIRRISTRDASI

SEQ ID NO: 851 - protein, 522 aa, Huperzia carinata
ILVFPFCVCMCARGSLLLHSGKILGSYLLQQNKAFAAREKDMEAFHGLVVARKQEELRAAQEMMNSLNAQLTHQTEAMDQAKKDMDEGLKRYRDEQVARAFFAVLKGVLEIGAAIFTGGATAGLAVKGAINAVNAVSNLAGMLDMVIKIMEGMEQVMEVLNAIDDLVTALSEINQMVEAPQMPSMPSTAEWDIFENEIEEVAESMPTEVTEARTWRTKCKNVAALCRAICTTGSYIGQVQYDLFVHSNQELIARRQAERLEAIQPANLTNYLEMATQMDMRTSRMLLGLLKVLTLQNGALKFHFLLPPKPFTGWVTMDMVRNALVQHEADALAARERLGPSTDFTWTYVVSDIPISLLLDGDDWIFTIDPADGSAFPLSWSRVRIRYLEMKFTGGEEFHKPTTNSGEVYILLQASRIFQDRLLGEVLHYEAAVPLRYQYAYALESGETTVSNRPSQQHDGEYMQMTPFCQWRLRLSASALENQGLAFPTAAADLNSSTTQVSITFWLTAIRRIDTRLLEVSQ

SEQ ID NO: 852 - protein, 824 aa, Polypodium musifolium
MFVRMDDLDVSSGCRSAMADLDYSKLYQDLNQISVRLEKTEFSEVMVVHRMFVRMDDLDVSSGSGLLSGAEKVKRLYVFADVVELPSKQVRLAGTDMIVVFCRIFVPEGRHYAELFLPSMNMSMVGADGEGSIRGVILSPTVLTTLSNALQFRLECGSMTSVMRLNDVSAGATLTCNVQGASACVPLKVKTTGTSPGNICVLGLSTAAVVPESVVAVITDANILLGMQVTVLIAELVKIAHNSDGVIAAVTRHVEWLNHLLVQAQAAAPSEDVVALLYRTQAFIKLRKEGLIVPRLQYHMYKDLIDRMVQVAQSYDQDFKQMKLYVEQNKILGSYLLEQNKAFAEKEKDMDASHSQVIALRTSELQSTIERMDDLSKQMEVQSKAMEKAKADMDAGLIVYQNKQVADAVFAVMEAIASIGLAFATGGATAPGAVASAGAAVSAAGKAGEGLKKVVEILEGLQAIMEVIAAIKGLVQSLQKIGQLVNAPEMPDLPSEAEWEMFVKEVEAVAAQMPTEVTQVPAWTAKCKNVAALGREMSTTAAHIAELQYEIQVQGMLQQIAKKQADRLSSIKPADLTNYFEMVSEMDMRTTRMLLELIQVLNIQNGALRYEYLQPAAPLNAWPVTMQTVWGLLVQQEAAAINGLLQLGAPSDFTREYVVGDIPVKLLLGGGDWEFELPVTDADFPLTWCRVRIQHVDMQFDAVAEHLPTTSTGEVYMLLQSSRFFEDRAQHEDEFISYEAGTGLQYQYAYRLATGEATVTNVPSEAYVNTFMLLAPFTRWRLRLSSSAPENKGLAFPTATSADATTRIKITFHVSAIRRISLAR

SEQ ID NO: 853 - protein, 902 aa, Polypodium punctatum
MANDTSSGIVDWRELYRDMNQASDRIRFNQLEFSEVMVIYRMHIKMSELDMGHLEGSEKVKRLYVFADVVEYDANGIARLPGSISVVFLCREWHVSYHLVARMDRNPPRYQLDLAQGVIISLPHMAWHLDVRRQSMHRLDPETLQEFLEPSFCVYADDISVAYYSLNGASWDPALQFPDTAELAKCALLIYSNSNPTPNHVLLTSNRFNGTRWAFRFEFSMYYIDNEDVAKDIALQPPGTRVIFKREGLHLVVLAMDSANRIISFDPERGDLDAYMPAFSLLRQDAKFPIELLTDPNILSAMQTSMLIGELVEVGNPSTAVTEVVHKHVKWLSKLLHQVIEEKNGKDVEDYIGLSFRAQYVIKKVGRIRGLVVPQLQYDVYSNLINRMAQVAESYDQALRQFRLFIQNNKILGGFLLEQNRAFAEKEKDMDVFYSELITQRQIELDNTLQKLKRLSLQMETQQADMEQAQADMEAGLRRFQNRQAARALFAVLGAIAAVGLAFLTGGATAPAALGAARTAVTVAGSVVSGLQRVLEVLEGLQAVMEIVVIIKDLFSALQDLTQAVDLPDMPEMPLQSDWLIFVNEVEAVAQGMPTEVSEVVAWKTKCKNVAVLGQEMTTTAAYISQLQYDIMMQDMLQQIARRQADRLSAIQLPDLTNFTEMVIQMDMRTTRILVALIKVMYIQNAALMYQYLSEPTPVSAWPVNMDTVWRMLVQHEQLAIQGLLRLGPAFDIVRTFVVKSIPVRLLLDGDDYQFEIPVEDPLTFPLSLSRVRIHHLEMKIVQGAHVHTPITATGKIYILLQGSRNFHDRNEGKIMHYEAATALDYQYAYQLDTGETTVTNLPSAEFLRTFTRMTPFTNWRLRLSASADENEGLAFPTATSADATTEIAITFHISAIRRISD

SEQ ID NO: 854 - protein, 907 aa, Polypodium punctatum
MASITSGAGADWRELYSEMNQVSERLRLDQLEFSEVMIIHRMHIKLSELDLGHLEGADKVKHLYVFADVVELDNAADPSTPVDVRLPGSISVVFLCRVWHVSRRLTVGVNSPQYWLPTFDGRPVRIQLPHVKWHMNTLTRSMHRIDPETLQDLSGPLLCVYADLLRTSLHPPVGHSNWDAALAFPSMTVLREVEVLPCFDHSTPRQGLLTLTSNAAPQWVNQLRAAFIFTDQDAMTEILSLPADASVILNKNRPSIILTAGQSGGYTDRNVSAPAFSVLREGAETPIDSLTDPNFLPAMQTSMLIAELVEVGRPSAAIIEVMHKHVEWLNNLLLQVIEAKKGKDDVEDYIQLSYRSQYILKNVGRIDRFVVPQLQYDTYSPLINRMAQVAESYDQALRQFRLFIQQTQQNKILGAFLLDQNRAFADKEKDMDIFYSELIAQRQIELHNTLQKMEQLSLQMETQSADMEQAQADMEAGLRRFQNERVARAVFGVLGAIAAVALAFVTGGATAGAAIGAAKTAVTLAGAAARGLQQVLEILDGLQAVMEVVGMIKELFESLQELGQAVDLPEMPEMPLESDWHIFVNEVEAVAEQMPTEVSEVVAWKTKCKNVAVLGREMITLATYISQLQYDIQMQDMLQQIARKQADRLSAIQLSIPNTGYTEMLMQMDMRTTRLLVALIRAVHIQNAALMYQYLSEPIPVSAWPVNMDAVWRILVQHEQSAIQGLLRLGPAFDIERVFVVEDIPVSLLLEGDDYEFDIPVEDNITFPLSLSRVRIHHLEMKFVASGGQKQVHMPVTDSGSVYILLQSSRNFHDRNERAVVHYEAATSLDYHYAYNLETGQIKVTNQPSAEFRKTFMRSTPFTNWRLRLSASAEENKGLAFPTATSADATTQIVVTFHISAVRQVAF

SEQ ID NO: 855 - protein, 922 aa, Polypodium punctatum
MHPTGHDGISNIPLEQCHDDYAEERQMKPRFETNGLELDYEKIYAGSNSIAREVGLDKVNCGEVMAIHQMFFRLDTLSQELLRRPELVKRLIVVADVVEIEGSNATLSLPGSSLVLIFCRILILKSRNLVLDLDNWNLRAASTTPLHRCSIRAQRVVIASGFSLYSSLLIQVKHKFEWSDGTHLDQYFGRPFYFTAIGINSSATITTTATSAMRSINTWPGTAPVSNFIRVNSEKFNVLVNAVPWKGVIDCQAALPSLDDLLHPDVISGFQSTLLIVETILNFQTDNPAIISLARQHAEWILDSLLQVVPLPDSTLGVPEAKTLLARAQILMKLPTDGSQHLRVPLLAYGEYQEDIERLLRNAEAYDQEYRELTRFVQLVEIIGSEFLQLSRSLAQRERDIEAFESLAVIRKQSELDQAIRRMNSLMPEIERRSFEMADAKARMEEGCLFYRMFTSYITVKCKTSKLTCLIAAGLEDYNRRQLTRAIFGILGALLQLCASLKFGGGADIAGGIATTVPAAIDLIHAVQDTSASTKLLAISQTLMDLEKIVDVVNAVNTLAESATELEDIVHAPELPLIPPYTWDILENDIEEFAALMPLEVSEVVTWKAKCRNLVAVCREICIAASFACEVQYELFVHARQQEMARRQAERLEGMQTAALSSYIELATQADMRTARLLLSLLNVLAGHQGALHYHYLMELEVFTSSWPTVDSVRTHLLQLNQRARARENALFGDGVLTVDLQHDYVLDAIPVSLLLSGEDWNFTINPERNASSFPTPWDYVRIRYVEMRFTGEHLPVSETGEIYLLLRSSANFQDRLEEQVLEYEAAVPLVYQYAYNLSTGATTLPNQPSESGKFFRMTPFTRWRLRLSASAYQNQGVSFPTLPGDPNSDSPVQITITFFVTALPQIQSRSLDMSDGDPTEE

SEQ ID NO: 856 - protein, 888 aa, Nephrolepis exaltata
MEYSDLYADVNQVSLRFQETEFSEVMVVHRMYLRLQDLDMKTQPFPSMLWGSEKVQRLYVVADVVELPSTPTTMLFPATVSVVILCRVLYVHDLSLHIGTCGIQFTLLRLRLVETKEGLVKIFPIPASASSKDTDIGLYIHTDRVIYRQNTSSDDVHILQPLQMRVWGIWADSTFSTEVRANWPTTLAVHVLILWLTASKGQRIPATESDLQRSDEFELLCPPTPDKLKVSFASPVPPGIPSPIEVDFENTFSFFRVPPADAIPTEVLTNPYIILGLQMNMLIAELVLAAHNSPRVINVVTKHVQWLNKILKPKLGLANDDILALVFRVQSFLKTANQPRSIVPRLQYHMYSKLIDHMVQVAQAYDQEFKQLKLFIVQNQILGSYLLEQNKAFASREKDMSAFHSQVVSLRRTELSTAIGRMDQLSVQMERENKEMDQARVDMMQAIKDYQKKQVANALFAVLGAIASVALAFATGGATAPGAVAAAGAAVTAAGKLAEGLQKVVEILQALEVVMEIVGAIRDLVESLQNLGKLIDAPEMPDMPSDADWRIFVNEVEAVAEQMPAEVVGSVAVWKAKCKNVAVLGQEMCTTAAHIGELTYQIKVEEMLQEIAQRQADRLEEITPADLSSYTEMLSQIDMRTTRLLLQLIRVLYIQNAAIKYEYLYDASSQLNSWPVSMDTVWSMLLQQENSALMGLLDLGPSTDFTRSVVVKDIPVGLLVDGNDWQFVISVEDSAAFPIGYSRVRIRYVELKFEQGSNEDGTVIHQPHTDSGLIYMLLQSSRFFRDRKRREILDYEASMGLAYAFAYNLTTGVPTVTNIPSQQYAHTFTSMTPFNNWRLRLSASAEENQGLTFPTATNSPDARTQIALTFHITAIRDIDTLAAADDDE

SEQ ID NO: 857 - protein, 900 aa, Nephrolepis exaltata
MATVVKAGRGTVTRDYEELFRDLNQISDRIRLDQMELSEVMVVHRMFIRLQELDLGHVEGAEKVKHLYVFADVVEVEEGGNSAVWAPLARLPGSITVVILCRVVSVAGILLMGSSTFNNAMRIQLPHMKLRAVEITTQSPAKLQMHRRDAALADEQYPALCIHASVIQCSNIRSAVPVNLQRFPVSLQFFSYMPDRESNEVVLSSASRQLVDEPVDSFNVHTLAPEYIKGVPIPEVATIDSASLSENSYSVQISRLNLSLSNSIAAEGELEPAFSLLKPKVPFTVLIDPNILLAMQTSVLIVELVELAHPSADTRDAVTKHKEWINQLLLQATSANGEGTNASLDEHRALLFRVQYLMKRIPGREDSLVIPRLQYDVYSSLINRMAQVAESYDQSLRQLKLFISQNRILGSYLLQQNQAFAEKERDMDVFHSELLSQRKLELEDTIHRMGLLGSQMETQQREMEQARADMEAGLREFRERQLARAMFSVLGAVAAVGLAFLTGGATAPAAVRAAHTAVSVTSSIRRMFETVMQVLDGIQAVMEWVVLIKELVSNIQDLNKLVEAPEMSEPVPTQADWDIFVNEIEAVAEQMPTEVSEVSTWKAKCKNVAALGREMTTMAVYISELQYEIKVQSMLQEIARSQADRLSNIQAANLRSYTEMVTQMDMRTTRMLVSLLEVLRIQNAALMYQFLSPPTLMDAWPVTMETVWRILVQHEHTAILGLMRLGPSFDFMRTYVVEGIPVDLLLDGEDWEFEIPVEDYITFPPTWSRVRIHHLEITFVQGADVHQPMTETGKVYILLQGSRIFHDRNQDDAILYEAATPLDYHYAYRLDTRETTLSNLPSHDFTRTFMRMTPFTNWRLRLSASAEENKGLRFPTATSADSTTQIAISFHVSAIRRVSL

SEQ ID NO: 858 - protein, 888 aa, Nephrolepis falcata
MEYSDLYADVNQVSLRFQQTEFSEVMVVHRMYVRLLDLDMTTEPHLQMLAGSEKVRRLYVVADVVELPATATNMRLPATASVVILCRVLYVQDVNSPYLACGLHFPLMPLRVVEDTQQGRVRVFPVVGGGSASVDMNNQIGLYIHADRVVYRQGTSTADPLQPLQLRVIGNGSTFSTEVRPDWPKTLEVSSLLMWLTLSKGQPIPAAESDLQRHDEVELLSPPSPDRLSVVFAYLAPGNLFSIAVDVEYIGAGFCYFRIPPADPVPTEVLTDPYVIIGLQMNMLIAELVLAAHNSPPVISVVTKHVEWLNKILQPKLSLPNDDILALLFRVQAFLKMAKQPRSVVPRLQYHMYSPLINRMVQVAQVYDQEFKQLKLFIVQNQILGSYLLEQNKAFASRETEMSSFHSQVVSLRRTELNNAIDRIDQLSVQMENENEAMDQAKEDMMQAIAEYEKKQLANALFAVLGAIASVALAFATAGATAPGAVAAAGAAVSAAGRLAEGLKKVVEILEGLAAVMEIVAAIRDLVESLQNLGQLVETPEMPDMPSNADWLIFVNEVEAVAEQMPAEVVGSVAVWKAKCRNVAVLGQEMCTTAAHIGELTYQIKVEEMLQEIAQRQANRLESLTPANLSSYTEMLSEIDMRTTRLLLQLIRLLHIQNAAIKYEYLYAAGEQLNSWPVSMDTVWSMLLQQENSALVGLLDLGPSNDFTRSFVIQGIPIGLLVDGNDWQFSIPVEDSPTFPIGYSRVRIRYVELRFDQGTSDEGRMIHQPSTSSGLTYMLLQSSPVFRDRRRREVLEYEASMGLAYAFAYNLTTGVPTLTNVPSPEFANTFMRMTPFNSNWRLRLSSSAMENQGLMFPTASSADDTTQITITFFISAIRGIDTRAAVEI

SEQ ID NO: 859 - protein, 872 aa, Nephrolepis falcata
MEYSDLYHDVNMLSLPLHRTELSEVMVVHRMHVKLRDLNLETAVSDKVHRLYVVADVVEVTLDTVSLPCKVSVVILCRVLHVEQSSVLFSSLLLPNMNVRVVLSNNRMQVYPMATDGSADDVALYIHADRVIRRQGAWTLVRVMHMSITGPESTFSVPHLPDPALFNRVMVNVQMDAGPSIPASESDLQRSDETELVSRVSNGVTVSASIAGSAWTMPADNPSATFTVFPNPPAQPVARGVLTNPYVIIGLQMNMLTAELVQAAHNAPLLIRAVTRHVEWLNKILVEALQVVSGNEDLLALLFRTETYLKMATESRSVVPRLQYHMYSDLIHRMVQVAQAYDDEFQRLRLFIAQNEILGSYLLEQNKALASREREMSAFHSQVVSLRRTELDNCLQRMDQLNVQMERENKAMEEAQEKMNEALEAHQRRGLARALFAVLGAIAAVALTVATGGAAAPAAVAAAGQAVTAAGTLAQGLKTVVEILEGLQALMDLVVIIRELVENLQTIGQLIDAPEMQEMPSNADWLIFVNEVEAVAAQMPEEVFGSVAVWKAKCRNVAVLGQEMCTMAAHIAELQQQIKLEELLQEIADRQADRLLGISAADLSSFTEMLTQIDMRTTRLLLQLIKLLHIQNVAINYEYLFPANGRLSSWPVTMHTVWEMLLQQESSAITGLLALGPSTDFARTFVVHDIPVGLLVDGFDWQFAIPVMDDSSAFPIGFSRVRIRHVELKFSAIDIDASATVHQPRTDNGFIYILLQSARSFSDRRVRQAMDYEASEGLAYPYAYNLTTGVPSLTNLPSQEHANTFMRMTPFTEWRLRLSSSAEENRGLTFPTATSPDDSTQISITFHITAIRAIDFRGMDDEERSKSDSSQK

SEQ ID NO: 860 - protein, 856 aa, Nephrolepis falcata
MASLTPDYYTIYKNVNQVSRPVASRQGSEVMSIHRMYFKLDMLKVELLTEADAVKELVVFADVVEIEGQKMDLPASRFVTIVCRILLVKEEDVELSFKFLEPAPYFQALDPGSQSALVWASSTQVRLSIHAQQVLCNSTRATMRVTHPVVIGNRIDLEYRCLEGQTHCEIIASVGTVSGTMNWQIEISSDHADLSAAQRSHELRSWEGQRETVWSVVEQNEWPAFTSLLDPVLIPLARLGDSNIILGMQSTLLIAELVLSYQTHAQDTVSAAHRHLQWLITNLLQVLKGNSLKEETREQLLALLARAESASKLPLDGTHTLIVPRLQYSQYRGLISSMAAVAQAYNSEFTAVNLFIQQNEILGGYLLQQNKAFAEREKDMTAFHGLVVERRKDELRAAQETMEDLNTQLAQQTEAMDQAKQDMDAGLKRYKNEQVARAFFSVLKAVLEIGAAIFTGGATAGQAVKGAVDAVNAVSSLAGKLDMVLSLMERMEKVMEVLNAINDLVTTLSEINKMVEAPEMPSMPSMYEWDIFENEMEEVAESMPEEVTEARTWKTKCRNVAAVCRAICSTASYIGQLQYDLFAHSNQELIARRQVERLEAIQPADLTDFLEMATQLDMRTSRMLLNLLKVLTVQNGALLFHFLLEPVPFTGWVNMDMVWNALVKHEADALVARERLGPSTDFVQTYVMSDIPISLLLDGDDWIFTIDPADGSTFPLSWSRVRIQYLEMKFTGGEEYHKPASNSGAVYILLQASRNFQDRLHERVLHYEAAVPLRYQYAYNLQSGETTVSNRPSQQHDGEYMQMTPFCQWRLRLSASALENQGLAFPTVAATDLASSTTQISITFYLTAVRSINMRQ

SEQ ID NO: 861 - protein, 838 aa, Osmunda regalis
MASVDYGEIYKNVNQITRPVATKECSEVMAIHRMYFQLDNLDVELLTKANTVKQLVVFVDVVEIESDNVKLPGSSQVTIVCRILHVKKNNVALNFDFLGPTKCNGRSTRGYARIMDDSPVFELSIYAQQLVGDDGAMLRVRHPVTVATIENGHDYEVREGNMEWQIWPYSSTGLSSAARSHELKTIGDHGRERTWLIIEQEWSRFIAVVPDLIPLRWLTDSNVLLGMEATLLTAELILSYQTDAQATVAAALQHVEWLNTQLLQVVEETDLEATGERLLSLLFRAQSLLKLPVDGSHTLIVPRLEYGLYRDLINRMTDVAEKYNSEFMQMNLFIQQNEILGTYLLEQNKVFAQKEKDMEVFHSSLVTLKQQELTAAMNKMDRLKTQLTEQKTAMDQAKKEMDEGLQKYKNEQVAKAFFAVIVGVLEIGLAIFTGGATAGAAVAGAAEAVEAVSEVAKTLGKVVDILKGLEKVMEVLNAIKDLTASLAEINQMVEAPQMPDMPSEADWAIFENEIEAVAESMPTEVSEVPTWKAKCKNVAAVCREITTTATYIGQLQYDLLVQSMQQQIAMRQAERLEAIQPADLTNYLELATQLDMRTCRMIVGLLKVLTLQNGALQYHFLLPPKPFTGWVSMDIVRNKLVQHDYEAVIARSQLGPSTDFTRTVVVEGIPVTLLLEGDDWNFTIPVHDSAFPSNWSRVRIRYLEMRFSSSEEVHQPTTNTGEVYILLQAARMFDDRLKGDVLHYQAAVPLQYQYAYDLNTGETTQSNLPSEEHTGEYMRMTPFTRWRLRLSASAYENQGLAFPTATALDSTTQISITFFLTAVRQIDTRLTELMDEPQ

SEQ ID NO: 862 - protein, 878 aa, Pellaea rotundifolia
MEYGSLYGDVNQVSLRFEKTEVSEVMVVHRMHVRLEELDMSSDKLKRLYVLADVVELPSQRQTIVIPATVSAIIMCRVLYIPYIWTVVDNCTLVLPHMRFRVVETSNIAPRTGQFFALPPSDAAVDNDVGSFGGLYIHADRFIYRQATSFTSDWVQPLGLRVRGSSTFSSTFRPDWPETLPVNNLNQTITLSLGSFLTPSDSDLQRSDEIEFLQTEPQRVQVVVDRGPGSQTGLVLLVENSPEISVFPAPSLEHVPADVLADPSIILGMQMNMLSAELVLAAHNSQQVIKAVSKHVEWLNKILLQVASPSDDILALLFRVQAFIKMAKQSRFVVPRLQYHAYSNLINRMVQVAQVYDQELRQLRLFIAQNEILGSYLLQQNKAFAEKEKDMSAFHSQVVSMRRSELSSTIEMMGRLSSQMETESEAMDEASDSMVAAIQEYERKQLARALFAVLGAIASVALAFATGGATAPGAVASAGAAVTAAGRLAEGLRRVVEILEGLQAVMEVVAAIRDLVESLENMGQLVEAPEMPEMPTNADWLIFVNEVEAVAEQVPEEVSEVPVWKAKCKNVAVLGQEMCTTAAHISELQYQIRVEEMLQEIAQRQADRLMGISAADLSSYTEMATQIDMRTTRMLLQLIKMLYIQNAAIKYEYLYPASERLNSWPVTMPTVWTMLLQQENAALLGLLDLGPSNDFTVTHVVKDIPVKLLVDGYDWHFEIPVEDSAIFPAGWSRVRIRYVELKFDKQGTDSNIVIHQPSTNTGEIYMLLQSSRFLSDRKREEVMDYEASTGLAYAYAYDLSTGATTLTNIPSEAHANTFMQMAPFTAWRLRLSASAMENQGLVFPTATSPDNTTQISITFYVTAIRRIDTRRQRADAEL

SEQ ID NO: 863 - protein, 564 aa, Pellaea rotundifolia
AATIYNSRGGEFKYSVHSSPMVEIVLHAGDLSQPALMAGWSVQAKPSPDAPAVLFLHSQQVLVITSNSPPISHTSVNVVLQAEGAAQYTLYSDHHQKEGDISEGLPTEIKLERSDLNSTLLAALEATVLTTELILSYMTDATETVTQATLYLEWLNNQLLYAQNGTTDASVSLDETVDRQFHNLMFQVQCLLNKPLVATGLLVPRLQYCTYSNLVNTMARIAENYNKEFRQLTLFIQQNEILGTYLLQQNKALAEREKEMEVFHSELQQVKKDDLMRSLVKLERLEVDMKNMSAEMEQAERDMEAGIIRYRNRQVARAVFSVLGGAIAQLASAFFTGGATAGPAVAGAANAVNQVTEVVTSLQRVVETLEKLVLVTEFLVAMRDLMNAVNDIHGGVPEVPALPDMPSDAEWAIFENEIEAVAAGMPEDVSEALTWKAKCKNVAALGREMVTLATVIGQLQYEIKVHELLQEIARNHSERLEAIQPADLKNYQEIATELDMRTIRMLLGLLEVLSLQNAALHYQYLLPPSPVTTANTNISMSTVWALLLQHEAVAVIRLADLGFA

SEQ ID NO: 864 - protein, 895 aa, Pellaea rotundifolia
MAAGSVGVDYRELYKDLEQISERVRMEQMEFSEVMVIHRMFINLRDLDLGHLEGAERVKRLYVLADVVEAQQSHEGANSLLTPTARFPGSISVVILCRVLWLREVSYGARITAFNVMWLQLPHTRLHAVERSATSIRMYRHGEDEDDDAYPALCIHASIVEYSKIERGHAVPQPSPSTYILRCFALRPSPNSSTNLVFSSQSRSLVDAPVREYFVYPEARNVFPSTFPTSAIIDPASLFRDWYTFRLASVTLNLSAADVSKDQLEPAISLLKDNIPAAILTDANILLTLQISVLIAELVQLAHPSKDTVEAIAKHVEWLNKLLLQATSNSTGMSSHDDYLALLFRVQCLMKTRRRARSLVVPQLQYNVYSNLINRMAQVAQSYDQALQNLKLFIVQNRILGSYLLEQNKAFAERERDMEVFHSEIIAQRMLELKNTILKMDHLSVQMETQREEMDRAREDMEAGLREFQNREVARAMFAVIGAIAMIGLAFVTGGAAAPGAVAAAGNAVTAAGQAARALQRVVEILEGLQAVMEVVVLIKDLVESLQNINQLVDAPEMPEMPSQADWSIFINEIEGVAEEMPVEVSEVSAWKTRCKNVAVLGQEMTTTAAYISQLQYDIKVNSMLQDISRGHADRLSTLRPADLSNYLEMVTQMDMRNTRMLVSLIKVVDMQNAALMYQYLSSPTPLNAWPVTMETVWSMLVQHEHGAVLGLMSLGPAFDFTRTYVVKDIPVSLLLQGEDWEFEIPVQDFVTFPSTWSRVRIHHLEMKFVKDSAHQPTTATGSVYMLLQGSRIFHDRRNHVIRSTDTILHYEAAVSLDYHYAYRLDTGDTTLSNLPSHDFLTTFMRMTPFTNWRLRLSASAEENKELDFPTATSADATTQIAITFHISAIRQTSL

SEQ ID NO: 865 - protein, 544 aa, Pellaea rotundifolia
MVEIVLHAGDLSQPALMAGWSVQAKPSPDAPAVLFLHSQQVLVITSNSPPISHTSVNVVLQAEGAAQYTLYSDHHQKEGDISEGLPTEIKLERSDLNSTLLAALEATVLTTELILSYMTDATETVTQATLYLEWLNNQLLYAQNGTTDASVSLDETVDRQFHNLMFQVQCLLNKPLVATGLLVPRLQYCTYSNLVNTMARIAENYNKEFRQLTLFIQQNEILGTYLLQQNKALAEREKEMEVFHSELQQVKKDDLMRSLVKLERLEVDMKNMSAEMEQAERDMEAGIIRYRNRQVARAVFSVLGGAIAQLASAFFTGGATAGPAVAGAANAVNQVTEVVTSLQRVVETLEKLVLVTEFLVAMRDLMNAVNDIHGGVPEVPALPDMPSDAEWAIFENEIEAVAAGMPEDVSEALTWKAKCKNVAALGREMVTLATVIGQLQYEIKVHELLQEIARNHSERLEAIQPADLKNYQEIATELDMRTIRMLLGLLEVLSLQNAALHYQYLLPPSPVTTANTNISMSTVWALLLQHEAVAVIRLADLGFA

SEQ ID NO: 866 - protein, 866 aa, Pteris cretica
MADVDYSVLYKDLNQISIRLEKMDFSEVMAVHRMFVRMDDLDVSSGTSGGLLVGAEKVKRLYVFADVVELPSKQVRLPGSDMIVILCRIFVQNGRHSTELFLPSMNVSMGAAGNGSIRGANLSTTIMSSSSNVLQFKLQSGTMTSAVRLKDVDAAAALTCDVQAVSASMPLTVMATGTSPGNIWVLGMTTAVVVPKSAVAVITEANILLGMQVTVLIAELVKTAYNSDAVIAAVTRHVEWLNHLLVQAHAAAPKLGMQVTVLIAELVKTAYNSDAVIAAVTRHVEWLNHLLVQAHAAAPNEDVVTLLYRTQAFLKLQREGLVVPRLQYHMYKNLIDRMVQVAQSYDQDFKQLKLYVEQNKILGSYLLEQNKAFAAKEKDMDAFHTQIITLRTTELNNTIERMDQLSKQMDEENEAMEQAKADMDAGLIEYQNKQVANALFAVLGAIASIGLAFATGGATAPGAVSAAGAAVTAAGKAAEGLKKVVEILEGLQVVMEVVAAIKELVQSLQQIGKLVDAPEMPDLPSNADWEIFVNEVEAVAEQMPTEVKQVPTWKAKCKNVAALGREMSTMAAHIAELQYQIQVQEMLREIAQKQADRLSSIKPADLTNYLEMVSEMDMRTTRMLLELIRVLYIQNAALQYEYLQTPAPLDAWPVAMSTVWNVLIQQEMSAITGLLELGAPSDFTQEYVVKDIPVSLLQGGQDWEFELPVSGADFPSSWLRVRIHHVAMQFDGSAAHVPTTNSGEVYMLLQSSRFFDDRARRATEFISYEAGMGLYYQYAYRLATGEATVTNIPSVEYANTFMRLTPFTRWRLRLSASAHENNGLAFPTATSADATTQIKITFSVSAIRRIISTYNPHISLPSDVDR

SEQ ID NO: 867 - protein, 873 aa, Pteris cretica
MDDEMEQEGLKVFAAQSDKDYEALYASVNQIARVVGMSKVRCGEVLAVYRMFVRLDSLDVAHLLQPERVRRLIVFADIVEIDKNSVALPGSALVLINCRLLHLKNRDVQLDLPYWIVENNHNAVALPRCSVRAQQVVVSPNAPTPPPLSSNGSLIIRVKLDLKWADNSPFTQYIVRYFSYNSHEAYTDIKAPVSTSKPPSFHWLLIPPLSDRRIKTAAINDIKWQADIAFQEALPSLDDLRNPHVIKGMESTVLIAETILIYRSDLMDAVTEALQHVQWINKSILEAVRLPNSESGLQLKRLAAHVQMLLKFPVDGSHSLKVPRLQYGKYDDLINRMSVVAEAYDSEFKTLKLFILGNQIIGDYMLTQMKLLAAKEKDVAGLESLIVLRKERELKEALETIDSLEKQLLKQFNEMTEAKTQMEQGLKEYENKKSAQALFAVLGASMQIAGSLMSGNISGVIGGVGGSISAMKDAIDAMDDLAASRSLLNVASGLVEVNRVFEVVNAVSELYETATSLEDLLEAEKMPNIPSSDWDMMENEVEAVAATMPTEVSEALVWKAKCKNVIAVCRELCSTAVSMSELQYDLFVHASMQEIAQRQAERLEEFRASDLGEVTEMATQVDMQTMRVLLSLLSTLAIQNGALQYNYLMVSEPFTGWPTVENVRSSLVRRQQQAIIESSHMGPSTIMPPHAYVLESVPVGLLLSGEDYMFTIDPSCSDFEDSWSRVRILHLEIKFTGGHLPRAGPRNEAYFLLQASSQFQDRWGAQVFHYEAAAPLMYQYAYNLNTGATTLPNMPFEEDTFLRMTPFTHWRLRLSASSPRNEGITFPTALAPDSTTQITVAFTVTAHPRPYVSFSLDGKIDVEQIPEKQPEDQ

SEQ ID NO: 868 - protein, 889 aa, Phegopteris hexagonoptera
RDSVDFGEYRDLNQVSERIRLDQMEFSEVMVIHRMHIKLSELDLGHLDGSEKVKLVYIFADVVESDEEQTGALPVRLPGSISVFIMCRVWHVSAYVGNNGRNHRRVLRLPHMTLHFRNSSSALRSLYRIDPATREDVSEPALSIYADVVQAVLQNPANIPTTSISTDELYFEASGSEILYTRQVLHERVGLFVVRFSQWGIPVTPSVLAHNYSVTSLTNASLASGGGPLPTSIYSPAFSRGMLTSDIPVTFLTDSHILPAFQTSVLIAELVELGRPSQATIDAVGKHLRWLSKLLLKVIEETKGTAFRQDEYLELSFRAQCLIKKMGNIRSLVVPQLQYSVYSGLINRMAQVAESYDQSLTQFRLFIQQNRILGSFLLEQNRAFAQREKDMDAFHLELISERETELENTLEKLDQLNSQMQEESAEMERARERMESSIMEFQRRTILRAVFSIFSALAALSLSFLTAGAAAPAAVAGASAAVNAVSTAATIAVTLKRIMKMLEILETVMEVVAIIKEVISNMQLVDELANAPEMPAMPSDHEWLMFENDIEEVAEEMPPEVSGVSAWKARCKNVAVLGREMITTTTYISQLQYEIKVQRMLQQIAKRQAERLLAIQLPSLTNYTEMVTEMDMRTTRILVTLIKVVEVQNAALMYQYLSQPTPVNAWPVTMDTLWRMLVQHEHSAIRGLLRLGPSFDAGNCNYVVRRIPVYLLTHGEDWQFEIPLQLNDDDENEEDEYPAQVPFPTSWSRVRIHHLEMKFVRAPHVHYPTTKTGSIYILLQGSRIFEDRNQGARVHFEAATSLDYHYAYRLDTGETTLSNVPSIEFTQTFMRMTPFTTWRLRLSSSAIENEGLAFPTAMQSGPDSTEIHPDATTEIQITFNISAVRQISF

SEQ ID NO: 869 - protein, 896 aa, Phegopteris hexagonoptera
MIAAGAEDKLMSTCTYESVSPGSAESPAKRIDDDEAAAADEEYLQDDMSSMYAYEKLADDHDHYADYEAIYNGLNQIARAVGIRNTVECGEVLAIHQMFMRLDTLSVENLLRPERVKHLIVFADVVEIEGAALTLPGSTLVLIACRLLRVKNRDVVLNLSWNLASSSSPPRCSICAQHVITTSSTPLSGCTLLIQVMHALTWSNGSTFTQYFGRQFSYSSQNSSSTAPPPNQSLSSIGVPPSSNFILVNSKTLNILINNIRWKGYIDFQVGLPSFDDLVEPHFIDAIESTLLIAEMILTFQTNVRDAVTAAKEHVEWINMALLQVVDGPNSDARFRLKILLARVQMLLKLSLYGSTPGLVVPVLEYGVYDRVIKEMVRVAELYNNEFNQLNLFIQQNQILGNYLLQQSKVLAERERDVEALESSIVARKRQELNGSIRRVELLEQQLQALASEMDEARENMETGLQVFRDRQIAFAFFAVLGAALQLGGSLRLTSIPEIVVGIGTSISDAVNLAQQVENAVASNNLVDVASKLVEVEKVIEVVNAIKQLHDNETELDDILNAPEIPIIPSSDWDIMENNMEEVAAGMPTEVSEVVTWKTKSKNVIAVCREICRTAISVSELQYELFVHGKQQEIAQRQAERLQQIQTVELGEYIEIATQVDMQTMRLLIILLGNLAIQNGALHYHFLLAPEPLTGWPSIDSVRRHLILQEEKALLAEEGMGVPVRLTREYVVEDIPVSLLLSGNDWIFTIDPSSLSETPVFPNTWNRVRIRYIEMKFTGEHLPQSPNTGKVYLLLQASSMFQDQYAQQVFHYEAATPHSYQFAYELDTGVTTLPNLPAQEGRHFLMTPFTRWRLRLSASAYQNQGVFFPGPASASTNISITFHVTSVVGIQTFHDI

SEQ ID NO: 870 - protein, 592 aa, Polystichum lepidocaulon
AHPSADTRATTARHLEWLSGILLQALSKAEGTPSHKEYLALSFRAQYLMKTKGTTRRLVAPQLQYDVYSPLINRMAQIAESYDNSLRQFKLFIAQNQILGNYLLEQNRAFAAKERDMDVFHSELVSQRENELKSTLNRMGHLSTQMDIQVAEMNKAHEEMEAGLRRFQNRRVAEAMFGVLRAIGAIALSFFTGGATAGLAVRAARSAVSAAGALQRVMDTLEDMQAVMEVVFIIKELVESLQDIGTLVNAPDMPEMPSKEAWDIFENEIEGVAEEMPEEVSEVSAWKTSCKNVAVLGREMITTAVYISQLQYDIKEHTMLQEIAQRHADRLSTIKAADLSSYTEMVMQMEMRTARIMVALIKVIHMQNAALMYQCLWPPTQVTTWPSLTIETVWIMLMQHEHSALLGLMRLGPSFDFMRTYVVKDIPVSLLLNGEDWEFEIPVNDYITFPSTWSRIRIHHLEMKFAQGAHVHQPTTDTGKVYILLQGLRTFYDRNEGDTLDYEAAMPLDYHYAYRLDSTGETTLSNLPSNDFIKTFMHMTPFTNWRLRLSASAEENKGLAFPTAEEDRKTGSDATTEIAITFYISAIRRISF

SEQ ID NO: 871 - protein, 718 aa, Selaginella erythropus
SSIIGVAAAAAGSYHIMGNAGSINYEEIYKNANNIGRSMATPMCSEVMSVARMYLRISDLHPTRLKQPEIVKELYVFADVLRLDSFEIVLPGSDIVYILCRMLHWTIPAPALGSTVYIQTPWLKLSSATVIICPQLQQSPLEWFIKAEHSTRTDAPAPLFLHAKQVLTTSNTGSSHLNVVLQLAQEVAQTYMLSDQRDVIDVNVESGYTLSRRDLNSTLLSAMEATVLIAELILRYMTHATETVVEATLHVEWLNKLLVNALKDTSTASGSDDEAVDKQLHNLLFQLQFLLTRPLGAGVIVPRLQYSTYSNLVSTMGRIAENYDKEFKQFTLFIEQNEVLGTYLLQQNKAFAEKEREMEVFHSELQQVKKDDLTRAFAKLEQLEVDMREMSAAMEQAEKDMEAGLIRYRNAQVARAVFSVLSAIAQLASAFFTGGATTGQAVAGAANAVNQVTGAVSSLQRVVEPLEKLVLVTEFLVAMRDLVNAVNDIVQQVAPEVPALPDMPSEAEWAIFENEIEAAADEMPEEVSERLQWRAKCKNVAALGREMVTLATVIGQLQYDIKVHELLQEVAQNHAERLEAIQPVDLKNYQEMATELDMRTTRMILGLLEVLSLQNAALHYQFLLPPSPVTTASTTISMSNVWTLLLQHEAAAVISLRICDRPRGDVCCQGHTRWLAARWGGLGLSDLRQRCGRFPIWLEPCADLICRDEVCKSWYRIR

SEQ ID NO: 872 - protein, 702 aa, Selaginella erythropus
MGNAGSINYEEIYKNANNIGRSMATPMCSEVMSVARMYLRISDLHPTRLKQPEIVKELYVFADVLRLDSFEIVLPGSDIVYILCRMLHWTIPAPALGSTVYIQTPWLKLSSATVIICPQLQQSPLEWFIKAEHSTRTDAPAPLFLHAKQVLTTSNTGSSHLNVVLQLAQEVAQTYMLSDQRDVIDVNVESGYTLSRRDLNSTLLSAMEATVLIAELILRYMTHATETVVEATLHVEWLNKLLVNALKDTSTASGSDDEAVDKQLHNLLFQLQFLLTRPLGAGVIVPRLQYSTYSNLVSTMGRIAENYDKEFKQFTLFIEQNEVLGTYLLQQNKAFAEKEREMEVFHSELQQVKKDDLTRAFAKLEQLEVDMREMSAAMEQAEKDMEAGLIRYRNAQVARAVFSVLSAIAQLASAFFTGGATTGQAVAGAANAVNQVTGAVSSLQRVVEPLEKLVLVTEFLVAMRDLVNAVNDIVQQVAPEVPALPDMPSEAEWAIFENEIEAAADEMPEEVSERLQWRAKCKNVAALGREMVTLATVIGQLQYDIKVHELLQEVAQNHAERLEAIQPVDLKNYQEMATELDMRTTRMILGLLEVLSLQNAALHYQFLLPPSPVTTASTTISMSNVWTLLLQHEAAAVISLRICDRPRGDVCCQGHTRWLAARWGGLGLSDLRQRCGRFPIWLEPCADLICRDEVCKSWYRIR

SEQ ID NO: 873 - protein, 575 aa, Polystichum polyblepharum
CGSDQRDVIDVNVESGYTLSRRDLNSTLLSAMEATVLIAELILRYMTHATETVVEATLHVEWLNKLLVNALKDTSTASGSDDEAVDKQLHNLLFQLQFLLTRPLGAGVIVPRLQYSTYSNLVSTMGRIAENYDKEFKQFTLFIEQNEVLGTYLLQQNKAFAEKEREMEVFHSELQQVKKDDLTRAFAKLEQLEVDMREMSAAMEQAEKDMEAGLIRYRNAQVARAVFSVLSAIAQLASAFFTGGATTGQAVAGAANAVNQVTGAVSSLQRVVTEFLVAMRDLVNAVNDIVQQVAPEVPALPDMPSEAEWAIFENEIEAAADEMPEEVSERLQWRAKCKNVAALGREMVTLATVIGQLQYDIKVHELLQEVAQNHAERLEAIQPVDLKNYQEMATELDMRTTRMILGLLEVLSLQNAALHYQFLLPPSPVTTARWTLLLQHEAAAVISLRICDRPRGDVCCQGHTRWLAARWGGLGDGEDWDFPISVRDAEDFPSGWSRVRISYVEMKFVRAGTGSDEEVHQPTTDTGKVYMVLRGEQLFADRKRGASLKYEAATPVEYQNAYRLVTGVGSSSSCR

SEQ ID NO: 874 - protein, 575 aa, Polystichum polyblepharum; identical to SEQ ID NO: 873

SEQ ID NO: 875 - protein, 609 aa, Polystichum tripteron
FIFYFFFHVQTAHNSPQLIKAVTRHVEWLNKMLVQLASPNDDILALLFRAQAYMKMAKQPHPVVPRLRYSMYSGLINRMVQIAQSYDDELKQLKLFIAQNEILGSYLLQQNQAFAAKEKSMSVFHSQVVSLRRIELDNAIEKMNRLSYQMDVEREEMEQARKDMEQALDDYEKKQIANAVFAVLGAIASAALGFVTGGATVAGAVAAAATAVGAIAKLAAMLNKVMGILEIVQQVVETVAALKEVVESINNIGHLVDAPEMPEMPSNADWLIFVNEMEAAADELPAEVGERTVWRAKCKNVAVLGQEMCTTGTHIAELQYQIKVEEMLQEIAERQAERLEGISSADLSSYMEMASQIDMRTTRLLLQLIKVLHIQSAALRYEYLYPASERLNSWPVSMETVWTMLLQQESSSLLGLLQLGVPNDATRTYVVKDIPVEVLQSGRDWPFVIPVDDYADFPSGWYRVRISHVELKIDQQAAGDANDIVIHQPSTATGKLYLLLQSSRFFSDRKPREVMEYEASMGLAYAYAYNLNTGEATLTNIPSSAYADTFMQMTPFTTWRLRLSASAEENQSLVFPTANSPTSTTQVSITFHLTRIRRIESRTFVGDVE

SEQ ID NO: 876 - protein, 721 aa, Polystichum tripteron
MGVPNHIMQLYKDMNQVSEAMRLDQMEFSEVMVIHRMYIKLEELDLGHLEGAEKVKRLYVFADMVEVGQSVVARLPGSFMVVILCRVLWLPDEGSTPFIMLPHLMKLRAVETSEPMQVPVGGDEMFLTGLGLFRAESDEEYPSLCIHAGVIQFSLRKVWSPSQRQFSIFNPHPPPTSTPLENIVFSSPYRKPDTRPVLRFFTSTFLNQRSQITTGPEYFTLDPASRAYTTLSIVTDPPVHWPPASVFDVNTLHPTFSVLDANIPDVLLTDDKILLAMQTSMLIAELVEVAHPASEDTRATTIAKHVEWLSGILLQALSKVEGSPSHYEYLALSFRAQYLIKTRRTTRRRVVPQLQYDIYSPVINRMAQIAETYDDSLRQFKLYIAQNQILGSYLLEQNRAFGAKERDLEVFHSELISQRENELRNTLIRMDDLSRQMDKQTAEMDKAKEEMEAGLRRFHSRTVANAMFGVLGAIGSIALGIFTGGATARRSARRAVSAAQEATRAANTLREVMRILERLEVVLEVVSILKELMESLQDLSTLVEAPEMPDLPTELDWNIFDNEIEGVAAQMPSEVSEVSAWKTKCKNVAVVGREMITTAAYISQLQYDIKEHSMLQEIAQRHADRLSAIKVADLSSYTEMVLQMEMRTARIMVSLIKVIHMQNAALMYQCLWPPTEVTTWPSLTIETAWIMLMQQEQSALLGLMRLGPSVGGEGHSCKPTA

SEQ ID NO: 877 - protein, 869 aa, Polystichum tripteron
MMMRPGFRTDVREDYEVIYAGSNSITREVGLSKVKCGEVMAIHRMFMRLDTLSQELLQQPELVKRLIVVADVVEIEGSGGILTLPGSFSVLIFCRLLILKRKDVVLDLGSWDLRVATTTPPLPRCSIRAQRVVIASSSPLASLLIQVKHELQWSNGSRFDQYFGRPFSFNSSEISSRSFPTTTTSTTSTKLAISTWPGTTPVSNFILVSSEKFNVLVNAVPWKGVIDCQAALPSLDDLMHPDVISGIQSTLLIVETILNYQTNNPTIILAAQQHVEWIVDSLLQVVHLPNSTTDVLELKTILARAQMLQKLPTDGSVQLRVPLLDYGEYQEDIDQLLINAAAYDQEYKELTRFVQQVQILGSEFLELSKNLAEKERQIETFESLAVIRKQNELDQAMRRIKTLQREIGRRSYEMAEARITMEEGLEDYKRRQLQNAVFGLLGALLQLFASVTFGGGAIDIAGAMATTVSAAIDTINLVEDSSASSKLLPMTQNLVDIEKVIEVVNAVNALVESATELEDIIHAPELPLISSYEWDIMENNIEELAALMPSEVSEVVTWKAKCRNLVAVCREICIAASFASEVQYELFVHARQQEMARRQAESLEQMQLASDLSAYVELATQADMRTTRLLLSLLNVLASHQGALYYHYLMEPEPFTFSWPSVDNVRMYLLELNHKARARESTLFGTGVLNVDMEQDYVVDSIPASLLLSGEDWNFTINPGRNASVFPVPWDYVRIRYVEIKFTGQHQPVTQTGEIYLLLKSSANFQDRFEDQVLEYEAAVPLVYQYAYNLGTGSTTVTNDPSTKGKFFRMTPFTHWKLRLSASAYQNEGVSFPTLLNAASDSPVQITITFYVTALPQIQHFSGGPTMEV

SEQ ID NO: 878 - protein, 852 aa, Polystichum tripteron
MEKDNPISGLGERSFYPPTPPVDSVTQAGNDLWLSFPGADKRDVYAHIYSNVNPIGTRAVSTPEPGKVVSVARIYLRLDQVIGHGADAAAGGIIQEMYIFADVIEIEGAKLNAEWEETVLGCHQYILLCNKLLADLTGIRRLQNLMRRVPLVVRLTNRHEPHLTMFTGRLFSPGAPVPHSSVVVHCNQFYCTDNNIINPNYVGLPPIPWAPRWALQHPSLLMAMESTITTSEVILHFIANTEGVDRLVEAMVSHVQWLNLTLLQALQERGTEQSAADLHELRMLFFRTQYLLKWPPGQISILVPRLHYTRFDNLIERMANVAEVYDRDFKQLTLFVAHNQAQGTYLFEQNKALAEREQDMEIAHSALYSMKEADLRRGIQNLETLGGQMQEMNAEMDQAREDMEAGLQRYRDQQIARAVFSILGAIAAIGVAILTGGIGARSALSRSKDAVNGVQTAVQTAARLKAVLKTVEKIVELVDVIWELKELIEEVADLAGMSLETPSRADLPEVPSAAEWYIFENEIEAVAADMPTEVSEVAVWKAKCKNVAALGREMTMQCVVVHELRYDIETHRLMAEVARSHADRLMSIQTFMDLTDYQRMATEIDMRTTRITLGLCKVLSLKHAAMRYEYLLPPSPLSITSFTISTIHSLLINQEVTAVAALNDLGIPTDHTITYLVRDIPIELLLDGEPWDFNIDSMADNLDFPSHWKRVRISHLQLHFTGARLPSTDTGAIYTLLESGSTFFDRGRPQLQEAIIQYEAMVPVAYQYAYDLQTGETTLSNKPSQQFANHFMRMTPFTQWRLRLPRTALENQGLCFPSPTPTPADATTQVSISFHLTAIRSRVHEHTVLRML

SEQ ID NO: 879 - protein, 675 aa, Polystichium tsus-simense
CNPASRLFHRRRHSPYSAGASTAAHSFAAATKSTFGAGTAGLIWTVSEVKKWYPSFKIVLPEVVPLQLLANSNIVLGVEVTALVSELIMTYQRQATELVAATLQHVDWLNTQLLSAQYSSGQLQALHFRVQALLKLLVGDDDAPLVVPPLQYEVYDDLINLMTSAAESYDNAFRQLNLFMQQNEILGSFLLDQNKAFSAKERDMESHHSQLVILQEAELTATNESIKSMNNELAQQNEAMDKAKADMEAGVKQYKDRLVAEAVFGVFRAIAQVCLAIFTGGASAAGAVETARKLSETAKALQSAVTHLEKLEKIVQVINSVTAFLENLQSLNQLIELPKMPDLPTEADWDMFENEVVAVAEGMPTEVSEVPMWKAKCKNVAALGREIIRTVAYMHQLQYDLAVNRMLQNIAQRQAERLEGLQIQDVDNYTEMATELDTRTNRMIMGLLKVLSLQTAALSYHYLLPPRSLTGWVNMDTVWNTLLNNKYDAVKALSSLGAAPTDTIQTYVVRDIPVGLLLEGNDWFFDIPIDDPAFPAPWFRVRIEHVELKFDPTSVHLPTTRNGQVYILLQAARFFADRVYGVVDEVLHFQATNTVHYQYAYRLDTGETTLNNRPTISSAAHYMRMTPFTRWRLRLSASAPQNEGLAFPTATTEDATTQITINFHLTGIHRIQYHA

SEQ ID NO: 880 - protein, 851 aa, Polystichium tsus-simense
MVDYGVVYAHVNEVGRRLGTGKVKCTRVLAKQGMLVRLDELTMEGLQDPYAVEQLVVFADVIEVAGTSVNFSAPIITIVCRILVLLDDSTRLDLTLPRAWNSLSNPARFSIFAQKVVSATPEPRRKSVVLQIRWRGSDMRGAEDVLPVSTAASDLGAEDVSPVSTAVPDLETAWGSIIFVLQGVPDAFRGRVEMNVLASLEVLLDPNVIISIQSTLLIAELILSYRTDLPETVQAAVEHAQWISNTLLAVCNFKCFHPYILHLPCTLMTMTITTCMAFTLMIFQVEASLNSSEEALELRNLLARAQMLLKFPTDGSQSLIIPRLEYRGYQSLIDRMAIVAESYTSELGQFMAFITQTQILLDDLVARTKAFAEKERDVADLQSSIVLRKRTELLQAEQTMMRLNDQLNKQAKDMEQAQHDMEQGLQEYKDREVARAFIGLLVAVVEVGVSFATGGLTALPAIKSSISAAKGLARLAEMIKAVIEVMERLAEAMEVLNAVRELIDAVAASKEIFEAPEMPDMPSIAEWDIFENEIELVAESMPEEVSEARVWRAKCKNVAAVCREVTRMGVYISQLQYELFVHAQQEAIARRHAERLEQIEAANLDNYLEMAMQIDMRTTRLLLGLLKMMSIQNAALQYHYLLPKEPFTGWPTIEIVRRRLIQKESQAVHGLEAMGMTTNFTRTFNVEDIPVDLLLSGEDWNFAIPPDSNSPFPLTFSRVRIRHVEMKFANTLALPSTTSGKLYILLQGSRTFHDRRFHEILEYEAAVPNAYPYAYNLSTGETTLSNEPSEHDAGNLLFFRMTPFTNWRLRLSSSAFENEGLLFPQGSTTTIIEITFHITAIRSIDTRLEVS

SEQ ID NO: 881 - protein, 886 aa, Pteris ensiformis
MEYSSLYGDVNQVSLRFQNTEFSEVMVVHRMHVRLEELDMTGVEGIEKVKRLYVLADVVELPSRATTVFEYVRLPATISAIILCRVLYIPEVQRLSGSAFVAQCSLDFPFMRLHVVGTSEGGAGVMQAFSSDAAASSIGVYLHADRFIYRQTTSTASDRVLPLDVRVSSGSSTFSTTARPDWPENLNVSFVTCGPQFLSKGPPLTSSDSDLQRSDEIELLDRQDGTPLLHVAFNPLAPGNVGGSQGRFQPSSACSFFHVPPPDVSADVLTDPSIILGMQMNMLIAELVLAAHNSPQVMNVVTKHVQWLNKILLQVASPNDDILALLFRIQAFMKMAKEPRFVVPRLQYHMYGSLINRMVQVAQNYDQEFRQLRLFIAQNKILGSYLLEQNRAFAEREREMSAFHLQVVSMRRSELRSAIETMNTLSLQMQTESEAMNEAQENMVEAIQEYERRLLARALFSVIGAIASVALAFATGGATAPGAVAAAGGAVSAAGRLAEGLQRVVDILQGLQTVMEVVVAIRDIVESLQNMGQLLEAPEMPEMPTNADWLIFVNEVEAVAEQVPTEVAEVPVWKAKCKNVAVLGQEMCTTGAYISELQYQITVEEMLQEIAQRQADRLVGISAADLSSYTEMASQIDMRTTRILLELIKMLYIQNAAIKYEYLYDANEKLNSWPVSMETVWTMLLHQENAALLGLLNLGPANDFTVTYAVKGIPVKLLVDGYDWNFEILVEDFAIFPSGWSRVRIRYVELKFDQQGTDSSNILIHQPSTNTGLVYMLLQGSRFLHDRKRGEVMDYEASMGPVYAYAYDLHTGATTLTNIPSQEYANTFMQTTPFNAWRLRLSASAMENQGLVFPTATSADSTTQISITFYVTAIRRIDHRQEGNVE

SEQ ID NO: 882 - protein, 878 aa, Cyathea cooperi
MEYSSLYSNPSLVNPNFQATEFSEVMVVHRMHVSLSHLNINTANSLLQPTLLQGSDKVKRLFIVADVVEAPTSRVFLPASLSVVVLCRLLYVTVPPPAFDTFGPAVTLTFPFMRFFVNEAIADFFPSKDDDAGIGCYIHADRIIRRLAMPQSDLRLRLIMTAEGPSTFSRDNWPISHFRFTQETVTADEPVAMADSELQRSDEYQQKDATVQFPLAVITFNPWLPPNGISDMGRGLDTTRPPVFCYFQFRSDVPSHILSNPYIVLGMQMTMLFAELVQVAHNSPHLLKLVTKHVEWLDKLLHQVTSPNDDILGLLFRVQVFKRTSERRHFLVPMLQYHMYSNLINRMVQAGEAYDRDLRNLQFFIATNQILGNYLLQQNKAFAEKEREMSGFHSNVVEMRRDELRNALDKMDLLALQMERENQAMQEARDALDKAILEYQRRLMANAILSVVRAVVSVALAFATAGATLAGAVASAGQAVSAAGQAAASLNKVVATLQALEGVMTFVIALREVVDSLGNMNNLINAPEQPELPSDADWLIFVNEIEAVAGQMPEEVVGPVSVWQSKCKNVAVLGQEMCTTTAHIGELTHQIKVEEMLQGIAQRQADRLNAISSPQDLSSFTEMLSEIDMRSLRLLLQLIRLLYIQNPALKYEYLFTTTDYLDTWPVNMETVRNVLIQQEAQAIRGLLQLGPSNDHTLTYVVKGIPVGLLVEGHDWVFSIPVQDFDAFPEGFSRVRIRYAELKFDAADQQTEGGMIHLPSTNTGLLYLLLQCSPSFADRKQQEVLDYEATSGVAYAYAYNLHTGAPTLTNIPSPEFANTFMRMTPFNTWRVRLSASAPENQGLSFLTANSPDDTTQITITFHFSAVRRIHHDPSQGTPI

SEQ ID NO: 883 - protein, 882 aa, Onoclea sensibilis
MEYSDLYADVNQVSMRFRETEVSEVMVVHRMHVRLQDLDMNGMPTNYSTVRRLYVVADVVELPSIVSNWMRFPGSLSVVILCRVLYVRDFNSVLGSCSLNFNFMRLRIVETKLGSVNVFPVPASASEDANNIGVYIHADRVIFRQDTSSSNIVRPVQLFVLGGSTFSTEVRPDWPTSLEVISIHLWPTLSKGQPISAAESDLQRSDEFELLPSPVGPDKVSIFFPSANPAPGNVIGQVLDVENIGAAFAFFHLPPLDPVPTEVLTDPYIISGLQMNMLIAELVLAAHNSPRVIKVVTKHVEWLNKMLQPKLHAAKDDILALLFRVQSFLKMAKEPRSVVPRLQYHMYSNLINRMVQVAQAYDQEFKQLQLFIVQNQILGRYLLEQNRAFASRERDMSSLHTQVVALRRTELNNAIDKMDLLSVQMERENEAMDQAKEDMMQAIEDYERRQVANALFAVLGAIASVALAFATAGATAPGAVAAAGAAVSAAGRLAEGLKRVVEILQGLEAVMEIVAAIRHLVESLQNIGSLIDAPAMPAGMPSDADWLIFVNEVEAVAEQMPAEVVGSVAVWKAKCKNVAVLGQEMCTTGAHIGELTYQIKVEEMLKDIAERQANRLEGITAADLSSYTEMLSQIDMRTTRLMLQLIRVLHIQNAAVKYEYLYDASRQLDSWPVSMETVWRLLLQQESDAITGLLSLGPSTDFTRSFVVKDVPVGLLLDGNDWQFVIPVEDSVAFPIGFSRVRIRYVELRFEQGSNDDGAAIHQPRTDSGSIYLLLQSSPFFSDRRRSAILDYEASMGLAYAFAYNLTTGVPTLTNVPSQEYANTFMRMTPFNNWRLRLSSSAEENRGLAFPTATSPDDRTQITLTFYITAIRGIDTRVLADE

SEQ ID NO: 884 - protein, 870 aa, Onoclea sensibilis
THFLECVGYWALCWRHQFPQPTCTIMGNVMTGPSYEEIYKNANYIHRSVATPICSEVMSVSRMYLALSELDVQRLKNPEIVKELYVFADVIFWDVFPTWPGLEAVFILCRVLVVDTRHLVAPSASSDGAEAAAADASVSIRAPWLNAPSTTFLISRREQIMPPFSCSIRAKHSTTRASTAPAAFCLQTEQVIDTSFSTNSAVSDNIVLKLETREGSSADDETVDDHIRESFPEVTLSWADVNLTLLWAMEATVLVAELISTYMSSSTRTVKEATLHLKWVNQLLIHALETKDGAPDAAVERLFNTLVLQVQLLLNNPSLVAGIVVPRLQYSTYRNLISTMAHMADGYTREFQQLIMFMEQNEVLGTFLLEQNQAFAAKERDMESFHAELHKVKTNDLIQALATLEQLEVLMTEMNAEMEQAQQDMEEGLRRFRNRQVARAVFSVFRSIVAIASSFFTGGATAGAAVQSTKNAVDQVVEMKSSLERIVETLEKLLLVSDFLVAMKELINAVQDVHGVAANVPTLPDMPTEAEWTIFENEIEAVAAEMPEEVSEVLVWKTKCKNMAAIGREMVTMATVISQLQYDVRMHDLLQEISRNQAERLEAIKPVDIRNYQEMATQLEMRTTHILLGLLEVLSLQNAAIQYQYLMPPSPVIMNNTIITMSDVWTQLLQQEAAAVVALSDLGFPTDRKVTYVVEGIPVGVLLDGQDWDFSISTEDVDHFPFGWSRVRIAYVEMKFVSARLGRSTEPAGNEDQIHEPITDTGEVYMILRGEQTFADRKRGEKVKYEAVAPVKYQYAYHVETGEMTEHNRPTEEFANHFMRMTPFTRWKLRMSGSARENRGLAFPTATAMDATTQIAIHFHVTAIRAADWH

SEQ ID NO: 885 - protein, 889 aa, Onoclea sensibilis
MARSAEAADAWREVYRDLNQVSERMRLDQLEFSEVMVIHRMHIKMSELDLGHLPGAEKVERLYVFADVVECDTPPYHSWSGPDLVIRLPGSMSVTFMCRVWHINHGVSQLQSFLDAKTLVLQIGHMRWHFNQTTGSMHRLDPQTLQNSPEPCFCVYAEVVRVAFYPDVTFPEFNNSPDLQFLQLQFGSDQLRFTSQTTNQPVWAIRGSLTFSMIPDNDGLLNEVSSQPAGTSFVLNMPDNLNVQLYANLNATSGTTLSRDPDSIIPAFSVLREKAVELLTDPNILPAMQTSMLIGELVEVGHPSEATLEVVRKHVEWLNHLLLQVIEAKQGQDVQDYIELSFRAQYVIKKVGRIHRPVVPQLQYNAYSNLINRMAQVAESYDQALRQFRIFIEQNKVLGGFLLEQNRAFAEKEADMDVFYSELITQRQIELDNTLQKMEHLGSQMDTQRADMEQAQADMEAGIRRFQDEQVARGLFAVLGAIAAVGLTVLTGGAAAPIALTAARRAVTLAGAVAQGLQRVLDILEGLQAVMEVIELIKDLISSLQELGQAVELPEMPEMPLDSDWLIFVNEVEGVAEQMPTEVSEVVAWKTKCKNVAVLGREMTTLAAYISQLQYDIKMQNMLQRIARKQADRLSAIQLPDLKNYAELVTQMDMRTTRLLVALIKVVYIQNAALMYQYLSEPTPVYAWPVNMDTVWRMLVQHEQFAVQGLMRLGPAFDIVRTYVVKSIPVSLLLEGDDYEFEILAEDHITFPLSLSRVRIHHLEMKFVQGGADVHMPITDTGSIYILLQGSRSFHDRNESAIIHYEAATSLDYHFAYRLDTGETTVTNLPSAEFVQTFMRMTPFSNWRLRLSASAEENKGLAFPTATSADATSHVAVTFFISAIRQVSL

SEQ ID NO: 886 - protein, 845 aa, Onoclea sensibilis
MGNVMTGPSYEEIYKNANYIHRSVATPICSEVMSVSRMYLALSELDVQRLKNPEIVKELYVFADVIFWDVFPTWPGLEAVFILCRVLVVDTRHLVAPSASSDGAEAAAADASVSIRAPWLNAPSTTFLISRREQIMPPFSCSIRAKHSTTRASTAPAAFCLQTEQVIDTSFSTNSAVSDNIVLKLETREGSSADDETVDDHIRESFPEVTLSWADVNLTLLWAMEATVLVAELISTYMSSSTRTVKEATLHLKWVNQLLIHALETKDGAPDAAVERLFNTLVLQVQLLLNNPSLVAGIVVPRLQYSTYRNLISTMAHMADGYTREFQQLIMFMEQNEVLGTFLLEQNQAFAAKERDMESFHAELHKVKTNDLIQALATLEQLEVLMTEMNAEMEQAQQDMEEGLRRFRNRQVARAVFSVFRSIVAIASSFFTGGATAGAAVQSTKNAVDQVVEMKSSLERIVETLEKLLLVSDFLVAMKELINAVQDVHGVAANVPTLPDMPTEAEWTIFENEIEAVAAEMPEEVSEVLVWKTKCKNMAAIGREMVTMATVISQLQYDVRMHDLLQEISRNQAERLEAIKPVDIRNYQEMATQLEMRTTHILLGLLEVLSLQNAAIQYQYLMPPSPVIMNNTIITMSDVWTQLLQQEAAAVVALSDLGFPTDRKVTYVVEGIPVGVLLDGQDWDFSISTEDVDHFPFGWSRVRIAYVEMKFVSARLGRSTEPAGNEDQIHEPITDTGEVYMILRGEQTFADRKRGEKVKYEAVAPVKYQYAYHVETGEMTEHNRPTEEFANHFMRMTPFTRWKLRMSGSARENRGLAFPTATAMDATTQIAIHFHVTAIRAADWH

SEQ ID NO: 887 - protein, 885 aa, Thelypteris noveboracensis
MEYSVLYGNVNQVSLRFEKTEFSEVVVVHRMHVRLAELNVTLGDTLLQGSDRVKRLYVLADVVEVPPNFSTWMSLPGTVSVVILCRILYFPYLEDASFASGWVVHAPLLRLRVVQTSTDFAQVFAIPENDSSAAAVADIGLYIHADRIIYRDDPARNIPVIEVQVRGNSTFSPYLPGFPDTGVKLSTVQCVREFSKGQPLAPEDSDLQRSDEIELIAPSGSEQRRLTAAFGDSTVVGVSLLFDPSTSFDFLSLGPSQINVPAAILSDPNIILGMQMNMLIAELVLAAHNSPQLIKAVTRHVEWLNKMLVQLASPNDDILGLLFRVQAYKKMAKQPHPVVPQLRYRMYQDFINRMVQIAQSYDGDLKQLKLFIAQNEILGSYLLEQNKAFAAKEKSMSAFHDQVVSLRKSELVNAIDKMNRLSYQMDVEREAMDQAQKDMEQGLEEYEKRQIVNAFFAVITAISLAALGFVTGGATVAGAVAAAGQAVNAVASLAATLQKVMGILQIIQQVVETVAAIREVIELFDNMGQLVAAPEMPEMPSNADWLIFVNEVEAMAEQLPVEVDARIVWKTKSKNVAVLGQEMCTIGTHIAELQYQIKVEEMLQKIAETQAERLEGISPADLSSYMEMVSQIDMRTTRLLLQLIRVLHIQNAALKYEYLYAADEQLDSWPVTMDTVWTMLLQQESASLSGLLSLGPANDDTRTYVVKDIPVEVLLSGGDWPFVIPVDDYTVFPAGWFYVRIRHVELKFEQQAGSDQNDIVIHQPSTNTGKLYMLLQSSRFFQDRNQAGVVMDYETSTGLSYPYAYNLNTGETTHQNVPSSEYAFTYMQMTPFTTWRLRLSAAAEENEGLVFHPPPTSPTSTTQISITFHVSRIRRIEYTLAGDVE

SEQ ID NO: 888 - protein, 896 aa, Thelypteris noveboracensis
MAAADDWSEVYRDLNQVSDRIRLDQLEFSEVMVIHRMHIKMSELDLGHLEGAEKVKHLYVFADVVEYDSLDAGLPGSIVRLPGSISVVIMCRVWHVSSLLIARPDLNNPQYVRSQDGVKLQLVHMKLYLNLVTNSMHRLDPQTLQEVPEPCLCVYAHVLRVAFRPDAGDSWDPALLFPAEYVLSTLEALIYDNDTPEHLLFNNSTFSRVWASRFQAIFRFINRDGLQIGSLPPGTIVTLNRDEPSLFSNAYRVNSTSLLNWTTISDVDWLAPAFSILRQRDIPVAVLTDPNILPAMQTSMLIGELVELGHPSAATIEVVDKHVKWLSNLWLQVIEEKKGKDVEEYLELLFRAQYVIKKVGRIRGLVVPQLQYDAYSNLINRMAQVAESYDQSLRQFRLFIQQNKILGRFLLEQNQAFAEKEKDMDIFYSELITQRQIELDNTLQKMKRLGSQMETQTAYMEQAQEDMEEGIRKFQNEQVARAIFGVIGVIAAVGLAFLTGGATAPAALGAARNAVTLAGTVAQTLQKVLDILEGLQAVMEIVAVINELVSSLQDLGQLLDLPEMPEMPMESDWLIFVNEVEAVAEQMPTEVSETIAWKTKCKNVAVLGREMITSATYISQLQYDIKVQSMLQQIAKKQADRLSNIQLPDLTNYTEMITQMDMRTTRMLVALIKVVYIQNAALMYQYLSEPTPVNAWPVNMETVWRMLVQHEQLAVQGLMRLGPAYDIVRTYVVEGIPVSLLLDGDDWEFEIPAEDRITFPLSLSRVRIHHLEMKFVQGANVHMPITDTGSIYILLQGSRNFHDRNEGEIIHYEAATSLEYHYAYRLDTGETTVTNLPSAEFVKTFMRMTPFTNWRLRVSASAEENKGLAFPLATSADATTQIAITFFISAIRQISL

That which is claimed is:

1. A polypeptide comprising a heterologous signal sequence or transit peptide operably fused to a PtIP-83 polypeptide having at least 80% sequence identity to the amino acid sequence of SEQ ID NO: 1, wherein the PtIP-83 polypeptide has insecticidal activity against and insect selected from Soybean Looper (*Chrysodeixis includens*), Corn Earworm (*Helicoverpa zea*), Fall Armyworm (*Spodoptera frugiperda*), and European Corn Borer (*Ostrinia nubilalis*).

2. The polypeptide of claim 1, wherein the PtIP-83 polypeptide has at least 90% sequence identity to the amino acid sequence of SEQ ID NO: 1.

3. The polypeptide of claim 1, wherein the PtIP-83 polypeptide has at least 95% sequence identity to the amino acid sequence of SEQ ID NO: 1.

4. The polypeptide of claim 1, wherein the PtIP-83 polypeptide has at least one amino acid substitution, deletion, insertion and/or addition at the N-terminus or C-terminus compared to SEQ ID NO: 1.

5. The polypeptide of claim 1, wherein the PtIP-83 polypeptide is derived from a species of fern or primitive plant.

6. The polypeptide of claim 1, wherein the PtIP-83 polypeptide is a PtIP-83 polypeptide variant having at least one amino acid substitution compared to SEQ ID NO: 1, wherein the amino acid at position 1 is Met or deleted; the amino acid at position 2 is Ala or deleted; the amino acid at position 3 is Leu, Val, Ile or deleted; the amino acid at position 4 is Val, Met, Ile or Leu; the amino acid at position 7 is Gly, Thr or Ser; the amino acid at position 8 is Lys, Arg, Ser or Thr; the amino acid at position 10 is Phe, Trp or Tyr; the amino acid at position 11 is Glu, Asp, Lys or Arg; the amino acid at position 18 is Met, Val, Leu or Ile; the amino acid at position 19 is Gly, Pro or Ala; the amino acid at position 20 is Val, Ile, Leu or deleted; the amino acid at position 21 is Leu, Ile or Val; the amino acid at position 23 is Arg, Lys, Asn or Gln; the amino acid at position 37 is Val, Ile or Leu; the amino acid at position 38 is Arg, Lys, Gln or Asn; the amino acid at position 40 is Ala, Gly, Thr or Ser; the amino acid at position 43 is Asn, Gln, Glu or Asp; the amino acid at position 45 is Gly or Ala; the amino acid at position 46 is Gln, Asp, Asn or Glu; the amino acid at position 48 is Glu, Asp, Pro, Ile, Leu or Val; the amino acid at position 51 is Glu, Asp, Ala or Gly; the amino acid at position 52 is Lys, Arg, Ser or Thr; the amino acid at position 53 is Val, Ala, Cys or Thr; the amino acid at position 54 is Lys, Ala, Cys, Asp, Glu, Gly, His, Ile, Leu, Met, Asn, Gln, Arg, Ser or Thr; the amino acid at position 55 is Arg, Ala, Asp, Glu, Phe, Gly, His, Lys, Leu, Met, Asn, Gln, Ser, Thr, Val, Trp or Tyr; the amino acid at position 56 is Leu, Glu, Phe, Ile, Met, Thr or Val; the amino acid at position 57 is Tyr, Cys, Ile, Leu, Met, Thr or Val; the amino acid at position 58 is Val, Cys, Ile or Leu; the amino acid at position 59 is Phe, Leu, Met, Val or Tyr; the amino acid at position 60 is Ala, Cys, Gly, Ser, Thr or Val; the amino acid at position 61 is Asp, Glu, His or Ser; the amino acid at position 62 is Val, Ala, Cys, Ile, Leu or Thr; the amino acid at position 63 is Val, Ala, Cys, Ile, Leu, Met or Thr; the amino acid at position 64 is Glu, Ala, Cys, Phe, Gly, His, Ile, Leu, Met, Asn, Gln, Arg, Ser, Thr, Val, Trp or Tyr; the amino acid at position 65 is Leu, Ala, Cys, Phe, His, Ile, Met, Asn, Gln, Thr, Val or Trp; the amino acid at position 66 is Pro, Asp, Gly, Met, Gln or Arg; the amino acid at position 67 is Val, Pro, Ile, Leu, Ser or Thr; the amino acid at position 68 is Val, Arg, Phe, Ile, Leu, Lys or Gly; the amino acid at position 69 is Glu, Ala, Asp, Gly, Arg or Lys; the amino acid at position 70 is Trp, Thr, His, Tyr, Lys or Arg; the amino acid at position 71 is Arg, Pro, Lys or deleted; the amino acid at position 72 is Trp, Asp, Leu, Ile, Val, Glu or deleted; the amino acid at position 73 is Pro, Gln, Asn, His or deleted; the amino acid at position 74 is Pro, Met, Ser or Thr; the amino acid at position 75 is Gln, His, Asn, Lys or Arg; the amino acid at position 76 is Ile, Met, Val or Leu; the amino acid at position 84 is Ile, Leu or Val; the amino acid at position 91 is Trp or Phe; the amino acid at position 93 is Thr, Ser, Leu, Val or Ile; the amino acid at position 94 is Asp, Glu, Ala or Gly; the amino acid at position 96 is Arg, Lys, Thr or Ser; the amino acid at position 97 is Gln, Phe, Asn, Lys or Arg; the amino acid at position 98 is Ser, Thr or deleted; the amino acid at position 99 is Asp, Glu, Gly or Ala; the amino acid at position 100 is Thr, Ser, Gly or Ala; the amino acid at position 101 is Glu, Thr, Asp, Ser or Trp; the amino acid at position 103 is His, Arg, Lys, Glu or Gln; the amino acid at position 105 is Thr, Ser or Pro; the amino acid at position 108 is Lys, Arg, Asn, Asp, Gln or Glu; the amino acid at position 109 is Leu, Ile or Val; the amino acid at position 111 is Ala, Ser or Thr; the amino acid at position 112 is Ile, Arg, Thr, Leu, Val, Lys, Ser or deleted; the amino acid at position 113 is Gln, Ala, Gly, Asn or deleted; the amino acid at position 114 is Arg, Glu, Lys, Asp or Ile; the amino acid at position 115 is Glu, Asp, Asn or Gln; the amino acid at position 116 is Glu, Asn, Gln, Asp, Lys or Arg; the amino acid at position 117 is Asn, Val, Tyr, Ile, Leu, Gln, Trp or Phe; the amino acid at position 118 is Arg or Lys; the amino acid at position 119 is Trp, Thr or Ser; the amino acid at position 122 is Thr, Lys, Ser, Arg or Ala; the amino acid at position 124 is Ala, Gly, Ser or Thr; the amino acid at position 126 is Gly, Ala, Glu or Asp; the amino acid at position 127 is Met, Gly or Ala; the amino acid at position 128 is Asn, Gln, Arg or Lys; the amino acid at position 131 is Val, Ile, Leu, Ser or Thr; the amino acid at position 133 is Ile, Leu or Val; the amino acid at position 134 is His or Tyr; the amino acid at position 135 is Ala or Gly; the amino acid at position 137 is Glu, Asp, Arg or Lys; the amino acid at position 139 is Gln, Asn, Asp or Glu; the amino acid at position 140 is Val, Arg, Ile, Lys or Leu; the amino acid at position 141 is Gly, Ala, Thr or Ser; the amino acid at position 142 is Val, Ile, Leu or Pro; the amino acid at position 144 is Thr, Leu, Phe, Ile, Val or Tyr; the amino acid at position 145 is Met, Pro, Gln or Asn; the amino acid at position 146 is Ser, Gly, Thr, Ala, Gln or Asn; the amino acid at position 147 is Trp, Gln, Tyr or Asn; the amino acid at position 148 is Ser, Ala, Thr, Gly or Pro; the amino acid at position 149 is Ser, Thr or deleted; the amino acid at position 150 is Val, Ile, Leu or Tyr; the amino acid at position 152 is Arg, Ala, Val, Ile, Leu, Lys or Gly; the amino acid at position 154 is Ser, Trp, Thr, Asp or Glu; the amino acid at position 156 is Leu, Asp, Ile, Val, Asn, Glu or Gln; the amino acid at position 158 is Ser, Thr or Cys; the amino acid at position 159 is Val, Thr, Leu or Ile; the amino acid at position 162 is Ser, Thr, Gly or Ala; the amino acid at position 163 is Gly, Ala or deleted; the amino acid at position 164 is Phe or deleted; the amino acid at position 165 is Arg, Lys, Gly or Ala; the amino acid at position 166 is Ala, Arg, Met, Lys or Phe; the amino acid at position 167 is Val, Ile, Leu or His; the amino acid at position 168 is Ser, Thr, Gln or Asn; the amino acid at position 169 is Val, His, Ile, Leu, Ser or Thr; the amino acid at position 170 is Phe, Ile, Leu or Val; the amino acid at position 171 is Glu, Asn, Gln or Asp; the amino acid at position 172 is Val, Ala, Arg, Ile, Leu, Gly, Lys, Asp or Glu; the amino acid at position 175 is Ser, Arg, Thr, Lys or Trp; the amino acid at position 176 is Val, Leu or Ile; the amino acid at position 177 is Arg, Lys, Leu, Val or Ile; the amino acid at position 179 is Thr, Ile, Val, Leu or Ser; the amino acid at position 180 is Leu, Phe, Ile, Val, Ser or Thr; the amino acid at position 181 is Gly, Thr, Gln, Asn or Ser; the amino acid at position 182 is Ala, Leu, Phe, Val or Ile; the amino acid at position 183 is Thr, Ser, Ala or Gly; the amino acid at position 184 is Leu, Thr, Ser, Ile, Val, Lys or Arg; the amino acid at position 185 is Arg, Gly, Asp, Lys, Glu or Ala; the amino acid at position 186 is Pro, Val, Ile, Leu, Asn or Gln; the amino acid at position 187 is Asp, Thr, Glu or Ser; the amino acid at position 188 is His, Gly or Ala; the amino acid at position 189 is Ala, Arg, Pro, Lys, Gly or deleted; the amino acid at position 190 is Leu, Asn, Ile, Val, Gln or deleted; the amino acid at position 191 is Tyr or deleted; the amino acid at position 192 is Ser, Ile, Val, Leu, Thr or Asn; the amino acid at position 193 is Thr, Ser, Glu or Asp; the amino acid at position 194 is Thr or Ser; the amino acid at position 195 is Met or Thr; the amino acid at position 196 is Gln, His, Leu, Asn, Ile, Val, Thr or Ser; the amino acid at position 197 is Ala, Gly, Ile, Val or Leu; the amino acid at position 198 is Thr, Glu, Ser, Asp, Gly or Ala; the amino acid at position 199 is Pro, Lys or Arg; the amino acid at position 200 is Asn, Ser, Thr, Gln, Ala or Gly; the amino acid at position 201 is Ala, Leu, Glu, Ile, Asp or Trp; the amino acid at position 202 is Ser, Asp, Phe, Ile, Val, Thr, Glu or Leu; the amino acid at position 203 is His, Pro, Gly, Ala, Thr or Ser; the amino acid at position 204 is Ile, Trp, His, Leu, Val, Ala or Gly; the amino acid at position 205 is Ser, Asn, Leu, Val, Thr, Gln or Ile; the amino acid at position 206 is Ala, Gly, Asp, Tyr, Glu, Lys or Arg; the amino acid at position 207 is Phe, Val, Ile or Leu; the amino acid at position 208 is Asn, Ser, Pro, Gln, Thr, Val, Ile or Leu; the amino acid at position 210 is Arg, Asp, Glu, Lys, Ser or Tyr; the amino acid at position 211 is Ile, Ser, Leu, Val or Thr; the amino acid at position 212 is Val, Ala, Ile, Leu, Glu, Gly or Asp; the amino acid at position 214 is Pro, Lys or Arg; the amino acid at position 215 is Ser or Thr; the amino acid at position 217 is Tyr or Phe; the amino acid at position 218 is Arg, Lys, Thr or Ser; the amino acid at position 219 is Val, Ile, Leu or Ala; the amino acid at position 220 is Cys, Leu, Ile, Val, Thr or Ser; the amino acid at position 221 is Pro or His; the amino acid at position 222 is Leu, Arg, Lys, Ile, Val, Thr or Ser; the amino acid at position 224 is Asn, Gln, Thr or Ser; the amino acid at position 225 is Asp, Arg, Glu, Lys, Ser or Thr; the amino acid at position 226 is Thr, Ser, Gln or Asn; the amino acid at position 227 is Asp, Leu, Glu, Ile, Val or deleted; the amino acid at position 228 is Thr, Ser or deleted; the amino acid at position 229 is Tyr or deleted; the amino acid at position 230 is Leu, Ile, Val or deleted; the amino acid at position 231 is Gly, Ala or deleted; the amino acid at position 232 is Ile, Leu, Val or deleted; the amino acid at position 233 is Pro or deleted; the amino acid at position 234 is Ala, Pro, Gly or deleted; the amino acid at position 235 is Asp, Ile, Leu, Glu or Val; the amino acid at position 236 is Val, Ser, Ile, Leu, Thr, Asp or Glu; the amino acid at position 237 is Ala, Phe or Tyr; the amino acid at position 238 is Ala, Gly, Ser or Thr; the amino acid at position 239 is Val, Ser, Ile, Leu, Thr, Ala or Gly; the amino acid at position 240 is Leu, Val or Ile; the amino acid at position 243 is Asp or Glu; the amino acid at position 249 is Asn, Gln, Thr or Ser; the amino acid at position 252 is Leu, Ile, Val or Met; the amino acid at position 257 is Thr or Ser; the amino acid at position 259 is His, Ile, Val or Leu; the amino acid at position 266 is Ala, Ile, Leu or Val; the amino acid at position 267 is Cys, Ala or Gly; the amino acid at position 268 is His, Arg, Lys or Tyr; the amino acid at position 272 is Asp or Glu; the amino acid at position 273 is Val, Met, Ile or Leu; the amino acid at position 274 is Val, Ile, Leu or Met; the amino acid at position 278 is Gly or Ala; the amino acid at position 279 is Glu, Asp, Gly or Val; the amino acid at position 281 is Leu, Ile, Val, Gly or Ala; the amino acid at position 282 is Asn, Leu or Ile; the amino acid at position 285 is Asn, Gln, Thr or Ser; the amino acid at position 286 is Lys, Asp, Arg or Glu; the amino acid at position 287 is Leu, Ile or Val; the amino acid at position 290 is Pro, Gln, Asn, Lys or Arg; the amino acid at position 291 is Leu, Ile or Val; the amino acid at position 292 is Lys, Arg, Ile, Leu or Val; the amino acid at position 293 is Glu, Asp, Asn or Gln; the amino acid at position 294 is Ser, Asn, Thr, Gln, Arg or Lys; the amino acid at position 295 is Thr or Ser; the amino acid at position 296 is Gln, Asn or His; the amino acid at position 297 is Leu, Ile, Val or Met; the amino acid at position 300 is Ser or Thr; the amino acid at position 301 is Glu, Asp, Gly or Ala; the amino acid at position 302 is Ser, Pro, Thr, Gly or Ala; the amino acid at position 304 is Lys, Arg, Gln or Asn; the amino acid at position 313 is Val, Leu or Ile; the amino acid at position 314 is His, Glu, Asn, Asp or Gln; the amino acid at position 315 is Ala, Cys, Gly, Thr or Ser; the amino acid at position 316 is Ala, Ile, Leu or Val; the amino acid at position 317 is Met, Leu, Val or Ile; the amino acid at position 319 is Met, Leu, Val or Ile; the amino acid at position 320 is Val, Ile, Leu, Ala or Gly; the amino acid at position 321 is Arg, Lys or Pro; the amino acid at position 322 is Ile, Leu, Val or Phe; the amino acid at position 323 is Gly, Ile, Leu or Val; the amino acid at position 324 is Leu, Ile, Val, Thr or Ser; the amino acid at position 336 is Ser, Thr, Gln or Asn; the amino acid at position 339 is Asn, Lys, Gln or Arg; the amino acid at position 350 is Arg, Lys, Asn or Gln; the amino acid at position 351 is Glu or Asp; the amino acid at position 353 is Lys or Arg; the amino acid at position 354 is Gln, Asn, Lys or Arg; the amino acid at position 355 is Phe, Ile, Leu or Leu; the amino acid at position 356 is Lys or Arg; the amino acid at position 360 is Ile, Val, Leu, Gly or Ala; the amino acid at position 363 is Gln, Ala, Cys, Glu, Phe, Gly, His, Lys, Leu, Asn, Arg, Ser, Thr, Val or Trp; the amino acid at position 364 is Ile, Ala, Cys, Glu, Phe, His, Lys, Leu, Met, Asn, Gln, Ser, Thr, Val, Trp or Tyr; the amino acid at position 365 is Leu, Ala, Glu, Phe, Gly, His, Ile, Lys, Met, Asn, Arg, Val, Trp or Tyr; the amino acid at position 366 is Gly, Ala, Cys, Phe, His, Ile, Lys, Leu, Met, Asn, Ser, Thr or Val; the amino acid at position 367 is Ser, Ala, Cys, Asp, Glu, Phe, Gly, His, Ile, Leu, Met, Asn, Pro, Gln, Arg, Thr, Val or Trp; the amino acid at position 368 is Tyr, Ala, Cys, Asp, Glu, Phe, Gly, His, Ile, Lys, Leu, Met, Asn, Pro, Gln, Arg, Ser, Thr, Val or Trp; the amino acid at position 369 is Leu, Ala, Cys, Asp, Phe, Gly, Ile, Met, Thr or Val; the amino acid at position 370 is Leu, Ala, Cys, Asp, Glu, Phe, Gly, His, Ile, Lys, Met, Gln, Arg, Ser, Thr, Val, Trp or Tyr; the amino acid at position 371 is Gln, Ala, Cys, Asp, Glu, Phe, Gly, Ile, Lys, Leu, Asn, Arg, Ser, Thr, Val or Trp; the amino acid at position 372 is Gln, Ala, Cys, Asp, Phe, Gly, His, Ile, Leu, Asn, Arg, Ser, Val or Tyr; the amino acid at position 373 is Asn, Ala, Cys, Asp, Phe, Gly, His, Ile, Lys, Gln, Ser, Thr, Val or Trp; the amino acid at position 374 is Arg or Lys; the amino acid at position 376 is Phe, Ile, Val or Leu; the amino acid at position 378 is Glu or Asp; the amino acid at position 381 is Leu, Ile or Val; the amino acid at position 388 is Ala, Thr, Gly or Ser; the amino acid at position 395 is Arg or Lys; the amino acid at position 396 is Glu, Gln, Asp, Asn, Ala or Gly; the amino acid at position 399 is Asp, Gln, Glu or Asn; the amino acid at position 400 is Asn, Thr, Ser, Glu, Gln or Asp; the amino acid at position 401 is Thr, Ser, Gly or Ala; the amino acid at position 402 is Phe, Ile, Val or Leu; the amino acid at position 406 is Asp or Glu; the amino acid at position 408 is Leu, Ile, Val or Met; the amino acid at position 410 is Gly, Ile, Val, Ala or Leu; the amino acid at position 414 is Ala, Gly, Asp or Glu; the amino acid at position 416 is Ser, Asn, Thr, Gln, Glu or Asp; the amino acid at position 417 is Ser, Arg, Lys, Thr, Ala or Gly; the amino acid at position 423 is Lys, Arg, Asn or Gln; the amino acid at position 431 is Arg or Lys; the amino acid at position 432 is Gln, Asn, Asp or Glu; the amino acid at position 436 is Arg, Lys, Asp or Glu; the amino acid at position 440 is Asn, Gln, Lys or Arg; the amino acid at position 442 is Leu, Ile or Val; the amino acid at position 447 is Ser, Lys, Thr or Arg; the amino acid at position 448 is Ala, Gly, Thr or Ser; the amino acid at position 451 is Gln, Asn or Met; the amino acid at position 453 is Gly or Ala; the amino acid at position 455 is Ala, Leu, Ile or Val; the amino acid at position 457 is Leu, Ile or Val; the amino acid at position 467 is Val, Ile, Leu, Gly or Ala; the amino acid at position 471 is Gly or Ala; the amino acid at position 475 is Ser, Thr, Gln or Asn; the amino acid at position 483 is Gly or Ala; the amino acid at position 493 is Gln, Asn or Gly; the amino acid at position 504 is Val, Leu or Ile; the amino acid at position 506 is Asp, Glu or His; the amino acid at position 509 is Asp, Glu, Gln or Asn; the amino acid at position 510 is Ser, Thr, Gly or Ala; the amino acid at position 512 is Glu or Asp; the amino acid at position 515 is Gly, Ala, Thr or Ser; the amino acid at position 516 is Gln, Asn or His; the amino acid at position 517 is Ile, Val or Leu; the amino acid at position 519 is Asp, Asn, Glu, Gly or Gln; the amino acid at position 522 is Val, Glu, Pro, Ile, Leu or Asp; the amino acid at position 525 is Glu or Asp; the amino acid at position 526 is Leu, Ile, Val or Met; the amino acid at position 539 is Val, Leu or Ile; the amino acid at position 555 is Val, Leu, Ile or Ala; the amino acid at position 556 is Trp, Phe, Thr or Tyr; the amino acid at position 557 is Arg, Cys, Asp, Gly, His, Ile, Lys, Leu, Met, Asn, Pro, Gln, Ser, Thr, Val, Trp or Tyr; the amino acid at position 558 is Ala, Cys, Asp, Phe, Gly, His, Ile, Lys, Leu, Asn, Pro, Gln, Arg, Ser, Val, Trp or Tyr; the amino acid at position 559 is Lys, Ala, Cys, Phe, Gly, His, Ile, Leu, Asn, Gln, Arg, Ser, Thr, Val or Tyr; the amino acid at position 560 is Cys, Ala, Phe, Gly, Ile, Met, Asn, Arg, Ser, Thr or Val; the amino acid at position 561 is Lys, Ala, Cys, Asp, Glu, Phe, Gly, His, Ile, Leu, Met, Asn, Arg, Ser, Thr, Val or Tyr; the amino acid at position 562 is Asn, Cys, Asp, Glu, Gly, His, Leu, Met, Arg, Ser, Thr, Val or Tyr; the amino acid at position 563 is Val, Ala, Cys, Asp, Phe, His, Ile, Leu, Met, Asn, Gln, Thr or Trp; the amino acid at position 564 is Ala, Cys, Gly, Met, Gln, Ser, Thr, Val, Trp or Tyr; the amino acid at position 571 is Ser, Thr or Cys; the amino acid at position 575 is Val, Leu, Ile, Asp or Glu; the amino acid at position 577 is Met, Leu, Val or Ile; the amino acid at position 579 is Glu, Asp, Asn or Gln; the amino acid at position 583 is Asp or Glu; the amino acid at position 589 is Met, Ile, Val or Leu; the amino acid at position 590 is Met, Ile, Val or Leu; the amino acid at position 593 is Met, Leu, Val or Ile; the amino acid at position 595 is Arg, Lys, Asn or Gln; the amino acid at position 596 is Ser or Thr; the amino acid at position 597 is Gln, Asn or His; the amino acid at position 607 is Ala, Gly, Ile, Leu or Val; the amino acid at position 608 is Asp, Glu, Gln or Asn; the amino acid at position 612 is Tyr, His or Phe; the amino acid at position 617 is Thr, Ser, Leu, Val or Ile; the amino acid at position 618 is Gln, Asn or His; the amino acid at position 625 is Arg, Lys, Thr or Ser; the amino acid at position 626 is Met, Leu, Val or Ile; the amino acid at position 628 is Leu, Val or Ile; the amino acid at position 633 is Ile, Leu, Val or Met; the amino acid at position 634 is Leu, Ile, Val or Met; the amino acid at position 642 is Arg, Lys or Met; the amino acid at position 646 is Leu, Ala, Cys, Gly, Ile, Met, Asn, Gln, Ser, Thr or Val; the amino acid at position 647 is Leu, Asp, Gly, Met, Asn, Gln or Thr; the amino acid at position 648 is Met, Ala, Cys, Asp, Glu, Phe, Gly, His, Lys, Leu, Asn, Pro, Gln, Arg, Ser, Thr, Val, Trp or Tyr; the amino acid at position 649 is Pro, Ala, Cys, Asp, Glu, Phe, Gly, His, Lys, Met, Asn, Gln, Arg, Ser, Thr, Trp or Tyr; the amino acid at position 650 is Thr, Ala, Cys, Asp, Phe, Gly, His, Ile, Lys, Leu, Met, Pro, Gln, Arg, Ser, Val or Tyr; the amino acid at position 651 is Glu, Ala, Cys, Asp, Gly, His, Ile, Leu, Met, Asn, Pro, Gln, Arg, Ser, Thr, Val or Tyr; the amino acid at position 652 is Leu, Cys, Phe, Ile, Lys, Met, Pro, Arg, Ser, Thr or Val; the amino acid at position 653 is Thr, Cys, Asp, Glu, Phe, Gly, His, Ile, Lys, Leu, Pro, Arg, Ser, Val or Trp; the amino acid at position 654 is Thr, Ala, Cys, Phe, Ile, Lys, Leu, Met, Pro, Arg, Ser, Val, Trp or Tyr; the amino acid at position 655 is Trp, Phe or Tyr; the amino acid at position 658 is Gly, Lys, Ala or Arg; the amino acid at position 663 is Gly or Ala; the amino acid at position 664 is Asp, Glu, Gln or Asn; the amino acid at position 668 is Ala, Gly, Ser or Thr; the amino acid at position 669 is Gln, Asn or His; the amino acid at position 671 is Asn, Gln, Thr or Ser the amino acid at position 675 is Ile, Val, Ile, Thr or Ser; the amino acid at position 678 is Met, Ile, Ala, Leu, Ser or Thr; the amino acid at position 682 is Pro, Asn or Gln; the amino acid at position 683 is Ser, Thr or Pro; the amino acid at position 685 is Asp, Glu, Asp or Asn; the amino acid at position 694 is Asp, Glu, Ala or Gly; the amino acid at position 697 is Asn, Gln, Thr or Ser; the amino acid at position 704 is Glu, Asp, Ala or Gly; the amino acid at position 714 is Ala or Gly; the amino acid at position 721 is Ser, Thr or Phe; the amino acid at position 722 is Ser, Thr, Gln or Asn; the amino acid at position 724 is Ser or Thr; the amino acid at position 734 is His, Asn or Gln; the amino acid at position 736 is Val, Leu, Ile or Ala; the amino acid at position 737 is Lys, Arg, Asn or Gln; the amino acid at position 739 is Ala, Gly, Thr or Ser; the amino acid at position 740 is Ser, Thr or Met; the amino acid at position 741 is Gly, Ala, Gln or Asn; the amino acid at position 742 is Ile, Leu, Val, Ala or Gly; the amino acid at position 743 is Gly or deleted; the amino acid at position 745 is Gly, Ala, Glu or Asp; the amino acid at position 751 is Thr, Ser, Gly or Ala; the amino acid at position 753 is Gln, Asn, Lys or Arg; the amino acid at position 754 is Thr or Ser; the amino acid at position 756 is Thr, Ser, Leu, Val or Ile; the amino acid at position 757 is Val, Leu or Ile; the amino acid at position 766 is Ile, Leu or Val; the amino acid at position 771 is Arg, Ala, Asp, Glu, Phe, Gly, His, Ile, Lys, Leu, Asn, Ser, Thr, Val, Trp or Tyr; the amino acid at position 772 is Arg, Ala, Cys, Asp, Glu, Phe, Gly, His, Ile, Lys, Leu, Met, Pro, Gln, Ser, Thr, Val, Trp or Tyr; the amino acid at position 773 is Asp, Ala, Glu, Phe, Gly, His, Ile, Lys, Leu, Met, Asn, Gln, Arg, Ser, Thr, Val, Trp or Tyr; the amino acid at position 774 is Gln, Ala, Asp, Gly, His, Ile, Lys, Leu, Met, Asn, Pro, Arg, Ser, Thr, Val, Trp or Tyr; the amino acid at position 775 is Val, Ala, Cys, Asp, Glu, Gly, His, Ile, Asn, Pro, Gln, Arg, Ser, Thr or Tyr; the amino acid at position 776 is Leu, Ala, Cys, Asp, Glu, Phe, Gly, His, Ile, Lys, Asn, Pro, Gln, Arg, Ser, Thr, Val or Tyr; the amino acid at position 777 is Pro, Ala, Cys, Asp, Glu, Phe, Gly, His, Lys, Leu, Met, Asn, Gln, Ser, Thr, Val, Trp or Tyr; the amino acid at position 778 is Phe, Ala, His, Ile, Leu, Met, Asn, Gln, Ser, Val, Trp or Tyr; the amino acid at position 779 is Gln, Ala, Cys, Asp, Glu, Gly, His, Lys, Leu, Asn, Pro, Arg, Ser, Thr or Val; the amino acid at position 780 is Ala, Cys, Asn, Pro, Gln or Ser; the amino acid at position 781 is Ala, Cys, Asp, Glu, Phe, Gly, His, Ile, Asn, Gln, Arg, Ser, Thr, Val, Trp or Tyr; the amino acid at position 782 is Ala, Cys, Asp, Glu, Phe, Gly, His, Ile, Lys, Met, Pro, Gln, Arg, Ser, Thr, Val, Trp or Tyr; the amino acid at position 783 is Pro, Ala, Cys, Asp, Glu, Gly, His, Asn, Gln, Arg, Ser, Thr or Val; the amino acid at position 784 is Leu, Ala, Glu, Phe, His, Ile, Lys, Met, Asn, Pro, Gln, Ser, Thr, Val or Trp; the amino acid at position 785 is Asn, Ala, Cys, Glu, Phe, Gly, His, Ile, Lys, Leu, Met, Gln, Arg, Ser, Thr, Val, Trp or Tyr; the amino acid at position 786 is Tyr, Phe, Ile, Leu or Trp; the amino acid at position 787 is His, Asn or Gln; the amino acid at position 788 is Tyr or Met; the amino acid at position 789 is Ala, Lys or Arg; the amino acid at position 790 is Tyr or Thr; the amino acid at position 791 is Arg, Lys, Gly or Ala; the amino acid at position 792 is Leu, Ile, Val, Thr or Ser; the amino acid at position 796 is Asp or Glu; the amino acid at position 797 is Ser, Thr or Ala the amino acid at position 802 is Glu, Lys, Asp, Asn or Gln; the amino acid at position 806 is Gln, Asp, Glu, Asn or His; the amino acid at position 810 is Lys, Arg or Thr; the amino acid at position 819 is Arg, Lys or His; the amino acid at position 829 is Lys, Ser, Ala or Pro; the amino acid at position 832 is Ala, Lys, Arg, Asp or Glu; the amino acid at position 833 is Gly, Ala, Asp or Glu; the amino acid at position 842 is Leu, Ile, Val or Pro; the amino acid at position 847 is Gln, Asn, Asp or Glu; the amino acid at position 848 is Ile, Leu or Val; the amino acid at position 849 is Val, Leu, Ile, Gly or Ala; the amino acid at position 855 is Thr, Ser or Met; the amino acid at position 860 is Ile, Leu or Val; and the amino acid at position 864 is His, Asn or Gln, compared to SEQ ID NO: 1.

7. A recombinant polynucleotide encoding a PtIP-83 polypeptide having at least 80% sequence identity to the amino acid sequence of SEQ ID NO: 1, wherein the PtIP-83 polypeptide has insecticidal activity against and insect selected from Soybean Looper (*Chrysodeixis includens*), Corn Earworm (*Helicoverpa zea*), Fall Armyworm (*Spodoptera frugiperda*), and European Corn Borer (*Ostrinia nubilalis*), wherein the polynucleotide is operably linked to a heterologous regulatory element.

8. The recombinant polynucleotide of claim 7, wherein the polynucleotide is a non-genomic polynucleotide.

9. The recombinant polynucleotide of claim 8, wherein the polynucleotide is a cDNA.

10. The recombinant polynucleotide of claim 8, wherein the polynucleotide is synthetic polynucleotide.

11. The recombinant polynucleotide of claim 8, wherein the polynucleotide has codons optimized for expression in an agriculturally important crop.

12. A transgenic plant comprising the polynucleotide of claim 7.

13. A DNA construct comprising the polynucleotide of claim 7 operably linked to a heterologous regulatory element.

14. A transgenic plant or plant cell comprising the DNA construct of claim 13.

15. An agricultural composition comprising an insecticidal effective dose of the PtIP-83 polypeptide of claim 1, 3, 4, 5, or 6.

16. The agricultural composition of claim 15 further comprising at least one agriculturally acceptable carrier.

17. A fusion protein comprising the PtIP-83 polypeptide of claim 1, 3, 4, 5, or 6.

18. A method for controlling an insect pest population, comprising contacting the insect pest population with the PtIP-83 polypeptide claim 1, 3, 4, 5, or 6.

19. A method of inhibiting growth or killing an insect pest, comprising contacting the insect pest with a composition comprising the PtIP-83 polypeptide of claim 1, 3, 4, 5, or 6.

20. A method of controlling Lepidoptera and/or Coleoptera insect infestation in a transgenic plant and providing insect resistance management, comprising expressing in the plant the PtIP-83 polypeptide of claim 1, 3, 4, 5, or 6.

21. A method for controlling an insect pest population, comprising contacting the insect pest population with the transgenic plant or plant cell of claim 14.

22. A method of inhibiting growth or killing an insect pest, comprising contacting the insect pest with the transgenic plant or plant cell of claim 14.

23. The method of claim 20, wherein the insect or insect population is resistant to at least one Bt toxin.

* * * * *